(12) United States Patent
Zhang et al.

(10) Patent No.: US 11,624,072 B2
(45) Date of Patent: Apr. 11, 2023

(54) CANOLA WITH HIGH OLEIC ACID

(71) Applicant: CELLECTIS, Paris (FR)

(72) Inventors: Wenzheng Zhang, Highlands Ranch, CO (US); Feng Zhang, Maple Grove, MN (US)

(73) Assignee: Cellectis, Paris (FR)

( * ) Notice: Subject to any disclaimer, the term of this patent is extended or adjusted under 35 U.S.C. 154(b) by 0 days.

(21) Appl. No.: 17/259,456

(22) PCT Filed: Jul. 9, 2019

(86) PCT No.: PCT/IB2019/055853
§ 371 (c)(1),
(2) Date: Jan. 11, 2021

(87) PCT Pub. No.: WO2020/012365
PCT Pub. Date: Jan. 16, 2020

(65) Prior Publication Data
US 2021/0277411 A1 Sep. 9, 2021

Related U.S. Application Data

(60) Provisional application No. 62/695,388, filed on Jul. 9, 2018.

(51) Int. Cl.
*C12N 15/82* (2006.01)
*A01H 6/20* (2018.01)

(52) U.S. Cl.
CPC ......... *C12N 15/8247* (2013.01); *A01H 6/202* (2018.05); *C12Y 114/19006* (2013.01); *C12N 15/8213* (2013.01)

(58) Field of Classification Search
CPC ................... C12N 15/8247; A01H 6/202
See application file for complete search history.

(56) References Cited

U.S. PATENT DOCUMENTS 6,583,303 B1    6/2003   Debonte et al.
2021/0010013 A1* 1/2021  Gocal ................ C12N 15/8247

FOREIGN PATENT DOCUMENTS

| WO | 2004067736 A2 | 8/2004 |
| WO | 2011072246 A2 | 6/2011 |
| WO | 2016089677 A2 | 6/2016 |
| WO | 2016174119 A1 | 11/2016 |

OTHER PUBLICATIONS

Sivaraman et al (Development of high oleic and low linoleic acid transgenics in a zero erucic acid *Brassica juncea* L. (Indian mustard) line by antisense suppression of the fad2 gene. Molecular Breeding 13: 365-375, 2004). (Year: 2004).*
GenEmbl: DQ518271 (2016), DQ518277 (2016), DQ518280 (2016) and DQ518282 (2016) (Year: 2016).*
SEQ ID No. 10 Blast (Year: 2020).*
Sharafi et al (Oil Content and Fatty Acids Composition in *Brassica* Species. International Journal of Food Properties. 18:2145-2154, 2015) (Year: 2015).*
Demorest, Z.L., Coffman, A., Baltes, N.J. et al. Direct stacking of sequence-specific nuclease-induced mutations to produce high oleic and low linolenic soybean oil. BMC Plant Biol 16, 225 (2016). https://doi.org/10.1186/s12870-016-0906-1.
Pham, AT., Shannon, J.G. & Bilyeu, K.D. Combinations of mutant FAD2 and FAD3 genes to produce high oleic acid and low linolenic acid soybean oil. Theor Appl Genet 125, 503-515 (2012). https://doi.org/10.1007/s00122-012-1849-z.
International Search Report and Written Opinion for PCT/IB2019/055853, dated Nov. 8, 2019.

* cited by examiner

*Primary Examiner* — Charles Logsdon
*Assistant Examiner* — Wayne Zhong
(74) *Attorney, Agent, or Firm* — Dicke, Billig & Czaja, PLLC

(57) ABSTRACT

Materials and methods for creating canola (e.g., *Brassica napus*) lines having oil with increased oleic acid content are provided herein.

8 Claims, 7 Drawing Sheets

Specification includes a Sequence Listing.

Plant: c02

| | | (SEQ ID NO) |
|---|---|---|
| BnaA.FAD2.a | TCCTCCCCTCACCCTCTCTCCTACTTCGCCTGGCCTCTCTACTGGGCCTGCCAGGGCT | WT (53892) |
| BnaC.FAD2.a | TCCTCCCCTCACCCTCTCTCCTACTTCGCCTGGCCTCTCTACTGGGCCTGCCAAGGGT | WT (53893) |
| | TCCTCCCCTCACCCTCTCTCCTCTCTACTT----TGGCCTCTCTACTGGGCCTGCCAAGGGT | -4bp (53894) |
| BnaC.FAD2.b | TCCTCCCCCACCCTCTCCCCTTACCTCGCCTGGCCCCTCTACTGGGCCTGCCAAGGCT | WT (53895) |
| BnaA.FAD2.b-like | TACTTCCCTCTCCCTTACCTCGCCTGACCCCTCTACTGGGCCTGCCAAGGCTGCG | WT (53896) |

FIG. 2

Plant: e01

|  |  |  | (SEQ ID NO) |
|---|---|---|---|
| BnaA.FAD2.a | TCCTCCCTCACCCTCTCTCCTACTTCGCCTGGCCTCTCTACTGGGCCTGCCAGGGCT | WT | (53892) |
| BnaC.FAD2.a | TCCTCCCTCACCCTCTCTCCTCCTACT-----TGGCCTCTCTACTGGGCCTGCCAAGGGT | -5bp | (53897) |
|  | TCCTCCCTCACCCTCTCTCCTCCTACTT----TGGCCTCTCTACTGGGCCTGCCAAGGGT | -4bp | (53894) |
| BnaC.FAD2.b | TCCTCCCCCACCCTCTCCCTTACCTCGCCTGGCCCCTCTACTGGGCCTGCCAAGGCT | WT | (53895) |
| BnaA.FAD2.b-like | TACTTCCCTCTCCCTTACCTGCCTGACCCCTCTACTGGGCCTGCCAAGGCTGCG | WT | (53896) |

FIG. 3

Plant: e02

| | | | (SEQ ID NO) |
|---|---|---|---|
| BnaA.FAD2.a | TCCTCCCCTCACCCCTCTCTCCTACTTCGCCTGGCCTCTCTACTGGGCCTGCCAGGGCT | WT | (53892) |
| BnaC.FAD2.a | TCCTCCCCTCACCCCTCTCTCCTACTTCGCCTGGCCTCTCTACTGGGCCTGCCAAGGGT | WT | (53893) |
| | TCCTCCCCTCACCCCTCTCTCCTACT-----TGGCCTCTCTACTGGGCCTGCCAAGGGT | -5bp | (53897) |
| BnaC.FAD2.b | TCCTCCCCCACCCCTCTCCCTTACCTCGCCTGGCCTCTTACTGGGCCTGCCAAGGCT | WT | (53895) |
| BnaA.FAD2.b-like | TACTTCCCTCTCCCCTTACCTCGCCTGACCCCTCTACTGGGCCTGCCAAGGCTGCG | WT | (53896) |

FIG. 4

Plant: f02

|  |  | (SEQ ID NO) |
|---|---|---|
| BnaA.FAD2.a | TCCTCCCTCACCCTCTCTCCTACTTCGCCTGGCCTGGCCTGCCAGGGCT | WT (53892) |
| BnaC.FAD2.a | TCCTCCCTCACCCTCTCTCCTACTTCGCCTGGCCTCTACTGGGCCTGCCAAGGGT | WT (53893) |
|  | TCCTCCCTCACCCTCTCTCCTACT-----TGGCCTCTACTGGGCCTGCCAAGGGT | -5bp (53897) |
| BnaC.FAD2.b | TCCTCCCCCACCCTCTCCCTTACCTCCCGGCCCTCTACTGGGCCTGCCAAGGCT | WT (53895) |
| BnaA.FAD2.b-like | TACTTCCCTCTCCCTTACCTCGCCTGACCCCTCTACTGGGCCTGCCAAGGCTGCG | WT (53896) |

WT
```
BnaA.FAD2.a   CCCTGCGAGACACCGCCCTTCACTGTCGGAGAACTCAAGAAAGCAATCCCACCGCACT              (SEQ ID NO)
                                                                                     (53898)
BnaC.FAD2.a   CCCTGCGAGACACCGCCCTTCACTGTCGGAGAACTCAAGAAAGCAATCCCACCGCACT              (53898)
BnaC.FAD2.b   CCCTGCGAGACACCCCTTCACTCTCGGAGACCTCAAGAAAGCAATCCCACCTCACT                (53899)
```

Plant:Bn432-a
```
BnaA.FAD2.a   CCCTGCGAGACACCGCCCTTCACTG---GAGAACTCAAGAAAGCAATCCCACCGCACT     -3bp    (53900)
              CCCTGCGAGACACCGCCCTTCACTG------AACTCAAGAAAGCAATCCCACCGCACT     -6bp    (53901)

BnaC.FAD2.a   CCCTGCGAGACACCGCCCTTCACTGTT--AGAACTCAAGAAAGCAATCCCACCGCACT     -3bp,+1bp (53902)
              CCCTGCGAGACACCGCCCTTCACTG-------ACTCAAGAAAGCAATCCCACCGCACT     -7bp    (53903)

BnaC.FAD2.b   CCCTGCGAGACACCCCTTCACTCTCGGAGACCTCAAGAAAGCAATCCCACCTCACT       WT      (53899)
              CCCTGCGAGACACCACCCCT-------------CCTCAAGAAAGCAATCCCACCTCACT    -13bp   (53904)
```

Plant:Bn432-b
```
BnaA.FAD2.a   CCCTGCGAGACACCGCCCTTCACAGTTTCCAAAAGGTCGTTGATCAAAGCTCGCCGCG     +50bp,  (53905)
              TTGTTTCATCAAGCCAGAGAACTCAAGAAAGCAATCCCACCGCACT                 -6bp BnaC.FAD2.a   CCCTGCGAGACACCGCCCTTCACAGTTTCCAAAAGGTCGTTGATCAAAGCTCGCCGCG     +50bp,  (53905)
              TTGTTTCATCAAGCCAGAGAACTCAAGAAAGCAATCCCACCGCACT                 -6bp BnaC.FAD2.b   CCCTGCGAGACACCCCTTCACTGTCGCTGGAGACGGTCGTGTTGCCGGTG             -18bp,  (53906)
              CTGTGCCAGGCCCACGGCTTGACCCCGGAGCAGGTGGTGGCCATCGCCTTTTGCGTT      +166bp
              TCTACAAACTCTTCCTGGCTAGCGGTACGCGTATTAATTGCGTTGCGCTCACTGCCCG
              CTTTCCAGTCGGGGAAACCTGTCGTGCCCACCGCACT BnaC.FAD2.b   CCCTGCGAGACACCCCTTCACTCTCGGAGACCTCAAGAAAGCAATCCCACCTCACT       WT      (53899)
```

FIG. 7

T0 plant Bn432-a

| | BnaA.Fad2a | BnaC.Fad2a | BnaC.Fad2b |
|---|---|---|---|
| T0 | -3/-6 | -3,+1/-7 | -13/wt |

| T1 | BnaA.Fad2a | BnaC.Fad2a | BnaC.Fad2b |
|---|---|---|---|
| Bn432-01 | -3/-6 | -3,+1/-7 | -13/-13 |
| Bn432-02 | -3/-6 | -3,+1/3,+1 | -13/-13 |
| Bn432-03 | -3/-6 | -7/-7 | -13/-13 |

T0 plant Bn432-b

| | BnaA.Fad2a | BnaC.Fad2a | BnaC.Fad2b |
|---|---|---|---|
| | -6,+50/-6,+50 | -6,+50/-18,+166 | wt/wt |

| T1 | BnaA.Fad2a | BnaC.Fad2a | BnaC.Fad2b |
|---|---|---|---|
| Bn432-05 | -6,+50/-6,+50 | -18,+166/-18,+166 | wt/wt |
| Bn432-07 | -6,+50/-6,+50 | -18,+166/-18,+166 | wt/wt |

F1 →

F2

Group 1 (3-gene KO)
-6,+50/-6,+50  -18,+166/-18,+166  -13/-13
-3,+1/-3,+1
-7/-7
-18,+166/-3,+1
-18,+166/-7

Group 2a (2-gene KO)
-6,+50/-6,+50  -18,+166/-18,+166  wt/wt
-3,+1/-3,+1
166,-18/-7

Group 2b (In frame/in frame)
-18,+166 /-7  -13/-13
-3,+1/-3,+1

Group 2c (In frame/in frame)
-18,+166 /-7
-7/-7

→ F3 seed – FAME analysis

CANOLA WITH HIGH OLEIC ACID

CROSS-REFERENCE TO RELATED APPLICATIONS

This application is a National Stage Application of PCT/IB2019/055853, filed on Jul. 9, 2019, which claims priority from U.S. Provisional Application Ser. No. 62/695,388, filed Jul. 9, 2018. The disclosures of the prior applications are considered part of (and are incorporated by reference in) the disclosure of this application. A claim of priority to all, to the extent appropriate, is made.

TECHNICAL FIELD

This document relates to materials and methods for generating novel canola plants with improved oil characteristics. For example, this document relates to *Brassica* plants with novel mutations in fatty acid desaturase 2 (FAD2) gene copies.

BACKGROUND

Oilseed rape (*Brassica napus*) is an important crop that produces considerable amounts of edible oil—with about 40% of the seed being oil. Oilseed rape is grown for animal feed, biodiesel, and edible vegetable oils. The edible and processing qualities of the seed oil is determined primarily by the fatty acid composition of the triglycerol lipids. Oilseed rape with low erucic acid (canola) has five predominant fatty acids within the seed oil: 16:0 (palmitic acid), 18:0 (stearic acid), 18:1 (oleic acid), 18:2 (linoleic acid), and 18:3 (linolenic acid). Canola oil is valued, in part, for its saturated fatty acid content, as it has the lowest palmitic acid and stearic acid content of any vegetable oil, with about 6% of total fatty acids being saturated fatty acids.

The quality of canola oil also is determined by the relative composition of the mono- and polyunsaturated fatty acids, specifically, the relative composition of oleic acid, linoleic acid, and linolenic acid. Conventional canola cultivars normally produce oil with ~60% oleic acid, ~20% linoleic acid, and ~10% linolenic acid. Oil with high oleic acid can have a longer shelf life and greater heat stability during frying (Warner et al., *J Am Oil Chem Soc* 74:1317-1322, 1997; Matthaus, *Eur J Lipid Sci Technol* 108:200-211, 2006). Oil with low linolenic acid also can be beneficial for storage and extending shelf life (Scarth and Tang, *Crop Set* 46:1225-1236).

SUMMARY

Genes involved within the fatty acid synthesis pathway in *Brassica* include the fatty acid desaturase genes, FAD2 catalyzes the conversion of oleic acid (18:1) to linoleic acid (18:2). In *B. napus*, four copies of FAD2 genes have been identified (Yang et at, *Theor Appl Genet* 125:715-729, 2012). Due to limited studies on high oleic mutants, the individual contribution of most FAD2 gene copies on oil composition was not previously known. This document is based, at least in part, on the development of materials and methods for generating novel canola plants with improved oil characteristics. The resulting canola plants can be valuable to canola growers and the food industry. Thus, this document provides methods and compositions for using genome editing the generate modified *Brassica* plants that can be selected for enhanced oil characteristics, such as increased oleic acid content and decreased linolenic acid content. As described herein *Brassica* plants with enhanced oil characteristics can be generated using sequence-specific nucleases to inactivate or attenuate fatty acid desaturase 2 (FAD2) gene copies.

In a first aspect, this document features a *Brassica* plant, plant part, or plant cell containing an induced mutation in one or more FAD2 gene copies, wherein the plant, plant part, or plant cell produces oil that has increased oleic acid content and decreased linolenic acid content as compared to oil produced from a corresponding wild type *Brassica* plant, plant part, or plant cell. Each of the induced mutations can be within a nucleic acid sequence as set forth in any of SEQ ID NOS:1-3, or within a sequence having at least 90% identity to any of SEQ ID NOS:1-3. The induced mutation can include a frameshift, where the frameshift includes a deletion selected from the group consisting of a deletion of the guanine at position 253 of any of SEQ ID NOS:1-3 or at the corresponding position within a sequence having at least 90% identity to any of SEQ ID NOS:1-3; a deletion of the adenine at position 416 of any of SEQ ID NOS:1-3 or at the corresponding position within a sequence having at least 90% identity to any of SEQ ID NOS:1-3; a deletion of the adenine at position 99 of any of SEQ ID NOS:1-3 or at the corresponding position within a sequence having at least 90% identity to any of SEQ ID NOS:1-3; and a deletion of the guanine at position 322 of any of SEQ ID NOS:1-3 or at the corresponding position within a sequence having at least 90% identity to any of SEQ ID NOS:1-3. In some cases, the induced mutation can be an in-frame or frameshift mutation, where the in-frame or frameshift mutation includes an insertion or deletion selected from the group consisting of a 3 bp deletion at positions 98-100 of any of SEQ ID NOS:1-3 or at the corresponding positions within a sequence having at least 90% identity to any of ESQ ID NOS:1-3; a 6 bp deletion at positions 97-102 of any of SEQ ID NOS:1-3 or at the corresponding positions within a sequence having at least 90% identity to any of SEQ ID NOS:1-3; a 3 bp deletion at positions 99-101 and a 1 bp insertion at position 99 of any of SEQ ID NOS:1-3 or at the corresponding positions within a sequence having at least 90% identity to any of SEQ ID NOS:1-3; a 7 bp deletion at positions 98-104 of any of SEQ ID NOS:1-3 or at the corresponding positions within a sequence having at least 90% identity to any of SEQ ID NOS:1-3; a 13 bp deletion at positions 92-104 of any of SEQ ID NOS:1-3 or at the corresponding positions within a sequence having at least 90% identity to any of SEQ ID NOS:1-3; a 6 bp deletion at positions 96-101 and a 50 bp insertion at position 96 of any of SEQ ID NOS:1-3 or at the corresponding positions within a sequence having at least 90% identity to any of SEQ ID NOS:1-3; and an 18 bp deletion at positions 101-118 and a 166 bp insertion at position 101 of any of SEQ ID NOS:1-3 or at the corresponding positions within a sequence having at least 90% identity to any of SEQ ID NOS:1-3. Each induced mutation can have been induced by a rare-cutting endonuclease. In some embodiments, the plant, plant part, or plant cell may not contain a transgene. In some embodiments, the plant, plant part, or plant cell contains a transgene encoding a protein, where the protein is selected from the group consisting of a plant 5-enolpyruvylshikimate-3-phosphate synthase (EPSPS) protein, a modified plant EPSPS protein, a bacterial EPSPS protein, an agrobacterium CP4 EPSPS protein, an aryloxyalkanoate dioxygenase (AAD) protein, a phosphinothricin N-acetyltransferase (PAT) protein, an acetohydroxyacid synthase large subunit protein, a p-hydroxyphenylpyruvate dioxygenase (hppd) protein, and a dicamba monooxygenase (DMO) protein. The *Brassica* plant, plant part, or plant cell can be a seed. In some cases, a mutated FAD2 gene copy can include the sequence set forth in any of SEQ ID NOS:53900-53975, or a sequence at least 90% identical to the sequence set forth in any of SEQ ID NOS:53900-53975.

In another aspect, this document features a *Brassica* plant or plant part that is a progeny of the *Brassica* plant or plant part described above, where the progeny plant or plant part has a mutation in at least one FAD2 gene copy.

In another aspect, this document features a method for producing a *Brassica* plant having increased oleic acid content and decreased linolenic acid content, where the method includes providing a population of *Brassica* cells containing functional FAD2 gene copies, contacting the population of *Brassica* cells with one or more rare-cutting endonucleases targeted to the one or more FAD2 gene copies, regenerating *Brassica* plants from the population of *Brassica* cells contacted with the one or more rare-cutting endonucleases, and selecting a *Brassica* plant with a mutation in one or more FAD2 gene copies, where oil produced by the selected *Brassica* plant has increased oleic acid content and decreased linolenic acid content as compared to oil produced by a corresponding wild type *Brassica* plant. The *Brassica* cells can be selected from the group consisting of protoplast cells, embryo cells, callus cells, leaf cells, and petiole explant cells. The method can include transforming the *Brassica* cells with one or more vectors encoding the one or more rare-cutting endonucleases. The one or more rare-cutting endonucleases can be transcription activator-like effector (TALE) nucleases. Each of the one or more TALE nucleases can be targeted to a sequence within SEQ ID NOS:1-3, or to a sequence having at least 90% identity to a sequence within SEQ ID NOS:1-3. Each of the one or more TALE nucleases can be targeted to a sequence within any of the sequences set forth in SEQ ID NOS:9-29, or to a sequence having at least 90% identity to any of SEQ ID NOS:9-29. In some cases, a mutated FAD2 gene copy can include the sequence set forth in any of SEQ ID NOS:53900-53975, or a sequence at least 90% identical to the sequence set forth in any of SEQ ID NOS:53900-53975.

In another embodiment, this document features a method for generating a *Brassica* plant that produces oil having increased oleic acid content and decreased linolenic acid content as compared to oil produced from a corresponding wild type *Brassica* plant, plant part, or plant cell, where the method includes providing a first *Brassica* plant having at least one induced mutation in an endogenous FAD2 gene copy; providing a second *Brassica* plant having wild type FAD2 gene copies; and crossing the first *Brassica* plant with the second *Brassica* plant, thereby producing a plurality of progeny seed, wherein the progeny seed produce plants that contain an induced mutation in at least one endogenous FAD2 gene copy. Each of the induced mutations can be at a sequence within any of SEQ ID NOS:1-3. The induced mutation can include a frameshift, where the frameshift includes a deletion selected from the group consisting of a deletion of the guanine at position 253 of any of SEQ ID NOS:1-3 or at the corresponding position within a sequence having at least 90% identity to any of SEQ ID NOS:1-3; a deletion of the adenine at position 416 of any of SEQ ID NOS:1-3 or at the corresponding position within a sequence having at least 90% identity to any of SEQ ID NOS:1-3; a deletion of the adenine at position 99 of any of SEQ ID NOS:1-3 or at the corresponding position within a sequence having at least 90% identity to any of SEQ ID NOS:1-3; and a deletion of the guanine at position 322 of any of SEQ ID NOS:1-3 or at the corresponding position within a sequence having at least 90% identity to any of SEQ ID NOS:1-3. In some cases, the induced mutation can be an in-frame or frameshift mutation, where the in-frame or frameshift mutation includes an insertion or deletion selected from the group consisting of a 3 bp deletion at positions 98-100 of any of SEQ ID NOS:1-3 or at the corresponding positions within a sequence having at least 90% identity to any of ESQ ID NOS:1-3; a 6 bp deletion at positions 97-102 of any of SEQ ID NOS:1-3 or at the corresponding positions within a sequence having at least 90% identity to any of SEQ ID NOS:1-3; a 3 bp deletion at positions 99-101 and a 1 bp insertion at position 99 of any of SEQ ID NOS:1-3 or at the corresponding positions within a sequence having at least 90% identity to any of SEQ ID NOS:1-3; a 7 bp deletion at positions 98-104 of any of SEQ ID NOS:1-3 or at the corresponding positions within a sequence having at least 90% identity to any of SEQ ID NOS:1-3; a 13 bp deletion at positions 92-104 of any of SEQ ID NOS:1-3 or at the corresponding positions within a sequence having at least 90% identity to any of SEQ ID NOS:1-3; a 6 bp deletion at positions 96-101 and a 50 bp insertion at position 96 of any of SEQ ID NOS:1-3 or at the corresponding positions within a sequence having at least 90% identity to any of SEQ ID NOS:1-3; and an 18 bp deletion at positions 101-118 and a 166 bp insertion at position 101 of any of SEQ ID NOS:1-3 or at the corresponding positions within a sequence having at least 90% identity to any of SEQ ID NOS:1-3. Each induced mutation can have been induced by a rare-cutting endonuclease. In some embodiments, the first *Brassica* plant and the second *Brassica* plant do not contain a transgene. In some embodiments, the first *Brassica* plant and/or the second *Brassica* plant contains a transgene encoding a protein, where the protein is selected from the group consisting of a plant EPSPS protein, a modified plant EPSPS protein, a bacterial EPSPS protein, an agrobacterium CP4 EPSPS protein, an AAD protein, a PAT protein, an acetohydroxyacid synthase large subunit protein, a hppd protein, and a DMO protein. In some cases, a mutated FAD2 gene copy can include the sequence set forth in any of SEQ ID NOS:53900-53975, or a sequence at least 90% identical to the sequence set forth in any of SEQ ID NOS:53900-53975.

In yet another aspect, this document features a method for generating a *Brassica* plant that produces seed oil having increased oleic acid content and decreased linolenic acid content as compared to oil produced from a corresponding wild type *Brassica* plant, plant part, or plant cell, where the method includes providing a first *Brassica* plant having at least a first induced mutation in a first endogenous FAD2 gene copy, providing a second *Brassica* plant having at least a second induced mutation in a second endogenous FAD2 gene copy, and crossing the first *Brassica* plant with the second *Brassica* plant, thereby producing a plurality of progeny seed, wherein the progeny seed produce plants that contain the first and second induced mutations in the first and second endogenous FAD2 gene copies. Each of the induced mutations can be at a sequence within any of SEQ ID NOS:1-3. The induced mutation can include a frameshift, where the frameshift includes a deletion selected from the group consisting of a deletion of the guanine at position 253 of any of SEQ ID NOS:1-3 or at the corresponding position within a sequence having at least 90% identity to any of SEQ ID NOS:1-3; a deletion of the adenine at position 416 of any of SEQ ID NOS:1-3 or at the corresponding position within a sequence having at least 90% identity to any of SEQ ID NOS:1-3; a deletion of the adenine at position 99 of any of SEQ ID NOS:1-3 or at the corresponding position within a sequence having at least 90% identity to any of SEQ ID NOS:1-3; and a deletion of the guanine at position 322 of any of SEQ ID NOS:1-3 or at the corresponding position within a sequence having at least 90% identity to any of SEQ ID NOS:1-3. In some cases, the induced mutation can be an in-frame or frameshift mutation, where the in-frame or frameshift mutation includes an insertion or deletion selected from the group consisting of a 3 bp deletion at positions 98-100 of any of SEQ ID NOS:1-3 or at the corresponding positions within a sequence having at least 90% identity to any of ESQ ID NOS:1-3; a 6 bp deletion at positions 97-102 of any of SEQ ID NOS:1-3 or at the corresponding positions within a sequence having at least 90% identity to any of SEQ ID NOS:1-3; a 3 bp deletion at positions 99-101 and a 1 bp insertion at position 99 of any of SEQ ID NOS:1-3 or at the corresponding positions within a sequence having at least 90% identity to any of SEQ ID NOS:1-3; a 7 bp deletion at positions 98-104 of any of SEQ ID NOS:1-3 or at the corresponding positions within a sequence having at least 90% identity to any of SEQ ID NOS:1-3; a 13 bp deletion at positions 92-104 of any of SEQ ID NOS:1-3 or at the corresponding positions within a sequence having at least 90% identity to any of SEQ ID NOS:1-3; a 6 bp deletion at positions 96-101 and a 50 bp insertion at position 96 of any of SEQ ID NOS:1-3 or at the corresponding positions within a sequence having at least 90% identity to any of SEQ ID NOS:1-3; and an 18 bp deletion at positions 101-118 and a 166 bp insertion at position 101 of any of SEQ ID NOS:1-3 or at the corresponding positions within a sequence having at least 90% identity to any of SEQ ID NOS:1-3. Each induced mutation can have been induced by a rare-cutting endonuclease. In some cases, the first *Brassica* plant and the second *Brassica* plant do not contain a transgene. In some embodiments, the first *Brassica* plant and/or the second *Brassica* plant contains a transgene encoding a protein, wherein the protein is selected from the group consisting of a plant EPSPS protein, a modified plant EPSPS protein, a bacterial EPSPS protein, an agrobacterium CP4 EPSPS protein, an AAD protein, a PAT protein, an acetohydroxyacid synthase large subunit protein, a hppd protein, and a DMO protein. In some cases, a mutated FAD2 gene copy can include the sequence set forth in any of SEQ ID NOS:53900-53975, or a sequence at least 90% identical to the sequence set forth in any of SEQ ID NOS:53900-53975.

In another aspect, this document features a method for producing *Brassica* oil having increased oleic acid content and reduced linoleic acid content, where the method includes (a) providing a *Brassica* plant or plant part having an induced mutation in one or more FAD2 gene copies, and (b) producing oil from the plant or plant part. The induced mutation can include a frameshift, where the frameshift includes a deletion selected from the group consisting of a deletion of the guanine at position 253 of any of SEQ ID NOS:1-3 or at the corresponding position within a sequence having at least 90% identity to any of SEQ ID NOS:1-3; a deletion of the adenine at position 416 of any of SEQ ID NOS:1-3 or at the corresponding position within a sequence having at least 90% identity to any of SEQ ID NOS:1-3; a deletion of the adenine at position 99 of any of SEQ ID NOS:1-3 or at the corresponding position within a sequence having at least 90% identity to any of SEQ ID NOS:1-3; and a deletion of the guanine at position 322 of any of SEQ ID NOS:1-3 or at the corresponding position within a sequence having at least 90% identity to any of SEQ ID NOS:1-3. In some cases, the induced mutation can be an in-frame or frameshift mutation, where the in-frame or frameshift mutation includes an insertion or deletion selected from the group consisting of a 3 bp deletion at positions 98-100 of any of SEQ ID NOS:1-3 or at the corresponding positions within a sequence having at least 90% identity to any of ESQ ID NOS:1-3; a 6 bp deletion at positions 97-102 of any of SEQ ID NOS:1-3 or at the corresponding positions within a sequence having at least 90% identity to any of SEQ ID NOS:1-3; a 3 bp deletion at positions 99-101 and a 1 bp insertion at position 99 of any of SEQ ID NOS:1-3 or at the corresponding positions within a sequence having at least 90% identity to any of SEQ ID NOS:1-3; a 7 bp deletion at positions 98-104 of any of SEQ ID NOS:1-3 or at the corresponding positions within a sequence having at least 90% identity to any of SEQ ID NOS:1-3; a 13 bp deletion at positions 92-104 of any of SEQ ID NOS:1-3 or at the corresponding positions within a sequence having at least 90% identity to any of SEQ ID NOS:1-3; a 6 bp deletion at positions 96-101 and a 50 bp insertion at position 96 of any of SEQ ID NOS:1-3 or at the corresponding positions within a sequence having at least 90% identity to any of SEQ ID NOS:1-3; and an 18 bp deletion at positions 101-118 and a 166 bp insertion at position 101 of any of SEQ ID NOS:1-3 or at the corresponding positions within a sequence having at least 90% identity to any of SEQ ID NOS:1-3. Each induced mutation can have been induced by a rare-cutting endonuclease. In some embodiments, the first *Brassica* plant and the second *Brassica* plant do not contain a transgene. In some embodiments, the first *Brassica* plant and/or the second *Brassica* plant contains a transgene encoding a protein, wherein the protein is selected from the group consisting of a plant EPSPS protein, a modified plant EPSPS protein, a bacterial EPSPS protein, an agrobacterium CP4 EPSPS protein, an AAD protein, a PAT protein, an acetohydroxyacid synthase large subunit protein, a hppd protein, and a DMO protein. In some cases, the mutated FAD2 gene copy can include the sequence set forth in any of SEQ ID NOS:53900-53975, or a sequence at least 90% identical to the sequence set forth in any of SEQ ID NOS:53900-53975.

Unless otherwise defined, all technical and scientific terms used herein have the same meaning as commonly understood by one of ordinary skill in the art to which this invention pertains. Although methods and materials similar or equivalent to those described herein can be used to practice the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

The details of one or more embodiments of the invention are set forth in the accompanying drawings and the description below. Other features, objects, and advantages of the invention will be apparent from the description and drawings, and from the claims.

DESCRIPTION OF DRAWINGS

FIG. 2 shows the genotype of T0 plant c02 at the individual BnaA.FAD2.a, BnaC.FAD2.a, and BnaC.FAD2.13 TALE nuclease target sites.

FIG. 3 shows the genotype of T0 plant e01 at the individual BnaA.FAD2.a, BnaC.FAD2.a, and BnaC.FAD2.b TALE nuclease target sites.

FIG. 4 shows the genotype of T0 plant e02 at the individual BnaA.FAD2.a, BnaC.FAD2.a, and BnaC.FAD2.b TALE nuclease target sites.

FIG. 5 shows the genotype of T0 plant f02 at the individual BnaA.FAD2.a, BnaC.FAD2.a, and BnaC.FAD2.b TALE nuclease target sites.

FIG. 6 shows sequences from the FAD2 alleles of mutant T0 plants Bn432-a and Bn432-b. Dashes indicate deletions, and underlining indicates insertions.

FIG. 7 is a diagram illustrating a scheme for generating F3 seeds to be analyzed for oil composition, showing the FAD2 genotypes of T0 plants Bn432-a and Bn432-b, T1 plants resulting from selfed T0 plants, and F2 plants.

DETAILED DESCRIPTION

Figure 1:
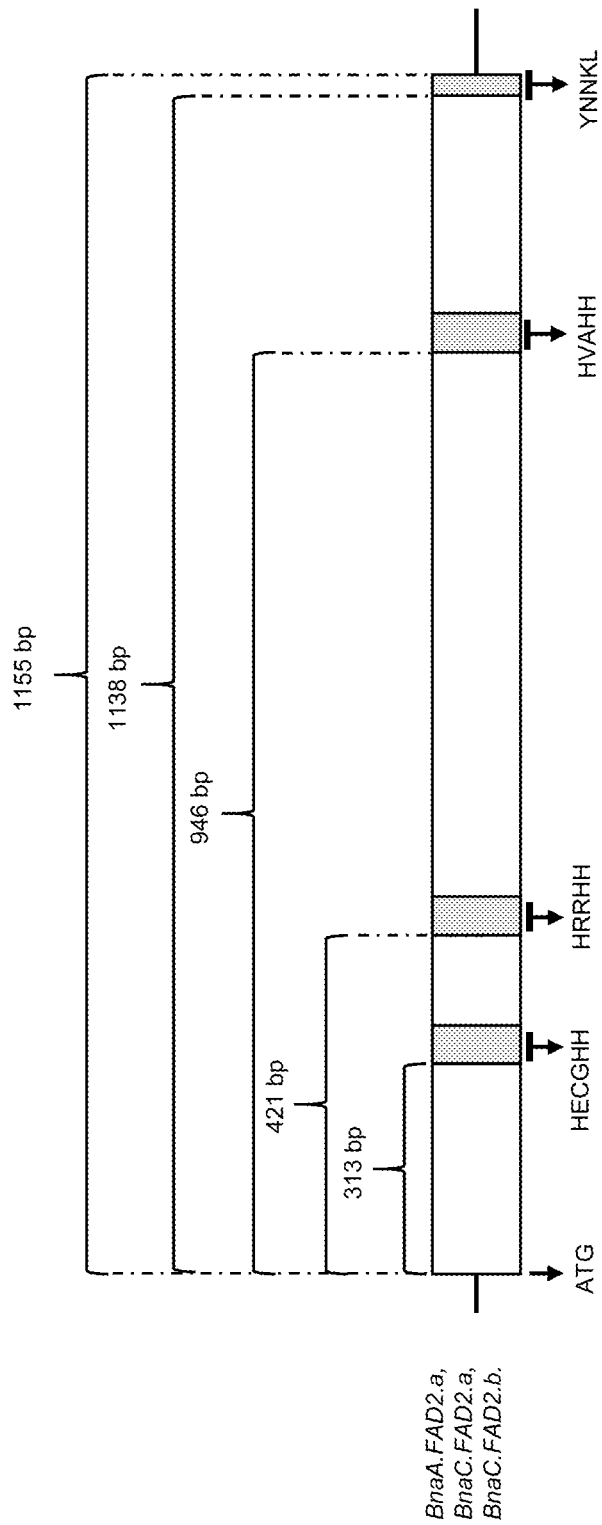
FIG. 1 is an illustration of the BnaA.FAD2.a, BnaC.FAD2.a, and BnaC.FAD2.b gene structures. Position of nucleotides encoding conserved amino acid sequences is shown.

Studies on canola lines with high oleic acid have been limited, providing incomplete information on the types and combinations of mutations which can result in specific oil compositions. This document provides *B. napus* plants that produce oil with desirable oleic and linolenic levels. More specifically, this document describes novel mutations, alone and in combination, that result in significant improvement in *B. napus* oil composition.

This document also provides novel methods for generating *B. napus* plants that produce oil with desirable oleic and linolenic levels. For example, this document relates to the finding that novel mutations within genes of canola plants can be created using sequence-specific nucleases. These sequence-specific nucleases can be used to inactivate or attenuate genes involved in the fatty acid synthesis pathway.

In some embodiments, the target gene for inactivation or attenuation is a member of the fatty acid synthesis pathway. For example, the target gene can be FAD2, which catalyzes the conversion of oleic acid (18:1) to linoleic acid (18:2). In *B. napus*, four copies of FAD2 genes have been identified (Yang et al., supra). As used herein, the four gene copies are named BnaA.FAD2.a, BnaA.FAD2.b-like, BnaC.FAD2.a, and BnaC.FAD2.b.

The FAD2 gene copy BnaA.FAD2.a is located on chrA05. A representative example of the coding sequence for BnaA.FAD2.a is shown in SEQ ID NO:1:

```
                                        (SEQ ID NO:1)
ATGGGTGCAGGTGGAAGAATGCAAGTGTCTCCTCCCTCCAAAAAGTCT

GAAACCGACAACATCAAGCGCGTACCCTGCGAGACACCGCCCTTCACT

GTCGGAGAACTCAAGAAAGCAATCCCACCGCACTGTTTCAAACGCTCG

ATCCCTCGCTCTTTCTCCTACCTCATCTGGGACATCATCATAGCCTCC

TGCTTCTACTACGTCGCCACCACTTACTTCCCTCTCCTCCCTCACCCT

CTCTCCTACTTCGCCTGGCCTCTCTACTGGGCCTGCCAGGGCTGCGTC

CTAACCGGCGTCTGGGTCATAGCCCACGAGTGCGGCCACCACGCCTTC

AGCGACTACCAGTGGCTGGACGACACCGTCGGCCTCATCTTCCACTCC

TTCCTCCTCGTCCCTTACTTCTCCTGGAAGTACAGTCATCGACGCCAC

CATTCCAACACTGGCTCCCTCGAGAGAGACGAAGTGTTTGTCCCCAAG

AAGAAGTCAGACATCAAGTGGTACGGCAAGTACCTCAACAACCCTTTG

GGACGCACCGTGATGTTAACGGTTCAGTTCACTCTCGGCTGGCCTTTG

TACTTAGCCTTCAACGTCTCGGGGAGACCTTACGACGGCGGCTTCGCT
```

```
-continued
TGCCATTTCCACCCCAACGCTCCCATCTACAACGACCGTGAGCGTCTC

CAGATATACATCTCCGACGCTGGCATCCTCGCCGTCTGCTACGGTCTC

TACCGCTACGCTGCTGTCCAAGGAGTTGCCTCGATGGTCTGCTTCTAC

GGAGTTCCTCTTCTGATTGTCAACGGGTTCTTAGTTTTGATCACTTAC

TTGCAGCACACGCATCCTTCCCTGCCTCACTATGACTCGTCTGAGTGG

GATTGGTTGAGGGGAGCTTTGGCCACCGTTGACAGAGACTACGGAATC

TTGAACAAGGTCTTCCACAATATCACGGACACGCACGTGGCGCATCAC

CTGTTCTCGACCATGCCGCATTATCATGCGATGGAAGCTACGAAGGCG

ATAAAGCCGATACTGGGAGAGTATTATCAGTTCGATGGGACGCCGGTG

GTTAAGGCGATGTGGAGGGAGGCGAAGGAGTGTATCTATGTGGAACCG

GACAGGCAAGGTGAGAAGAAAGGTGTGTTCTGGTACAACAATAAGTTA

TGA
```

The BnaA.FAD2.a gene produces a protein with conserved domains and signaling motifs. A first conserved domain includes the histidine-rich motif HECGHH (SEQ ID NO:35), encoded by nucleotides 313-330 of SEQ ID NO:1. A second conserved domain includes the histidine-rich motif HRRHH (SEQ ID NO:36), encoded by nucleotides 421-435 of SEQ ID NO:1. A third conserved domain includes the histidine-rich motif HVAHH (SEQ ID NO:37), encoded by nucleotides 946-960 of SEQ ID NO:1. A signaling motif responsible for allowing FAD2 to selectively bind to and embed in the endoplasmic reticulum (YNNKL; SEQ ID NO:38) is encoded by nucleotides 1138-1152 of SEQ ID NO:1.

The FAD2 gene copy BnaC.FAD2.a is located on chrC05. A representative example of the coding sequence for BnaC.FAD2.a is shown in SEQ ID NO:3:

```
                                        (SEQ ID NO:3)
ATGGGTGCAGGTGGAAGAATGCAAGTGTCTCCTCCCTCCAAGAAGTCT

GAAACCGACACCATCAAGCGCGTACCCTGCGAGACACCGCCCTTCACT

GTCGGAGAACTCAAGAAAGCAATCCCACCGCACTGTTTCAAACGCTCG

ATCCCTCGCTCTTTCTCCTACCTCATCTGGGACATCATCATAGCCTCC

TGCTTCTACTACGTCGCCACCACTTACTTCCCTCTCCTCCCTCACCCT

CTCTCCTACTTCGCCTGGCCTCTCTACTGGGCCTGCCAAGGGTGCGTC

CTAACCGGCGTCTGGGTCATAGCCCACGAGTGCGGCCACCACGCCTTC

AGCGACTACCAGTGGCTTGACGACACCGTCGGTCTCATCTTCCACTCC

TTCCTCCTCGTCCCTTACTTCTCCTGGAAGTACAGTCATCGACGCCAC

CATTCCAACACTGGCTCCCTCGAGAGAGACGAAGTGTTTGTCCCCAAG

AAGAAGTCAGACATCAAGTGGTACGGCAAGTACCTCAACAACCCTTTG

GGACGCACCGTGATGTTAACGGTTCAGTTCACTCTCGGCTGGCCGTTG

TACTTAGCCTTCAACGTCTCGGGAAGACCTTACGACGGCGGCTTCGCT

TGCCATTTCCACCCCAACGCTCCCATCTACAACGACCGCGAGCGTCTC

CAGATATACATCTCCGACGCTGGCATCCTCGCCGTCTGCTACGGTCTC

TTCCGTTACGCCGCCGCGCAGGGAGTGGCCTCGATGGTCTGCTTCTAC

GGAGTCCCGCTTCTGATTGTCAATGGTTTCCTCGTGTTGATCACTTAC
```

-continued
```
TTGCAGCACACGCATCCTTCCCTGCCTCACTACGATTCGTCCGAGTGG

GATTGGTTGAGGGGAGCTTTGGCTACCGTTGACAGAGACTACGGAATC

TTGAACAAGGTCTTCCACAATATTACCGACACGCACGTGGCGCATCAT

CTGTTCTCCACGATGCCGCATTATCACGCGATGGAAGCTACCAAGGCG

ATAAAGCCGATACTGGGAGAGTATTATCAGTTCGATGGGACGCCGGTG

GTTAAGGCGATGTGGAGGGAGGCGAAGGAGTGTATCTATGTGGAACCG

GACAGGCAAGGTGAGAAGAAAGGTGTGTTCTGGTACAACAATAAGTTA

TGA
```

The BnaC.FAD2.a gene produces a protein with conserved domains and signaling motifs. A first conserved domain includes the histidine-rich motif HECGHH (SEQ ID NO:35), encoded by nucleotides 313-330 of SEQ ID NO:3. A second conserved domain includes the histidine-rich motif HRRHH (SEQ ID NO:36), encoded by nucleotides 421-435 of SEQ ID NO:3. A third conserved domain includes the histidine-rich motif HVAHH (SEQ ID NO:37), encoded by nucleotides 946-960 of SEQ ID NO:3. A signaling motif responsible for allowing FAD2 to selectively bind to and embed in the endoplasmic reticulum (YNNKL; SEQ ID NO:38) is encoded by nucleotides 1138-1152 of SEQ ID NO:3.

The FAD2 gene copy BnaA.FAD2.b-like is located on chrA01 based on synteny of *B. napus* and its two progenitor species, *B. rapa* and *B. oleracea*. A representative example of the coding sequence for BnaA.FAD2.b-like is shown in SEQ ID NO:4:

```
                                        (SEQ ID NO:4)
ATGGGCGCAGGTGGAAGAATGCAAGTCTCTCCTCCCTCCAGCTCCCCC

GGAACCAACACCCTCAAACGCGTCCCCTGCGAGACACCACCATTCACT

CTCGGAGACCTCAAGAAAGCAATCCCACCTCACTGCTTCAAACGCTCC

ATCCCACGCTCCTTCTCCTCTTCGACATCATCATCTCCTCCTCGGCTC

CTCCCTCTACCACCTCTCCACAGCCTACTTCCCTCTCCCTTACCTCGC

CTGACCCCTCTACTGGGCCTGCCAAGGCTGCGTCCTAACGGGCCTCTG

GGTCATAGCCCACGAGTGCGGCCACCACGCCTTCAGCGACCACCAGTG

GCTGGACGACGCCGCCGGCCTCGTCTTCCACTCCTTCCTCCTCGTCCC

GTACTTCTCCTGGAAGTACATCCATGACGCCACCATTCCAACACCGGA

TCCCTCGATAGGGACGAAGTGTTCGTCCCCAAGAAGAAATCCGACATC

AAGTGGTACGGCAAGTACCTCAACAACCCGCTAGGACGCACGGTGATG

CTAACCGTCCAGTTCAAGCTCGGCTGGCCGTTGTACTTAGCCTTCAAC

GTCTCGGGAAGACCTTACAGCGACGGTTTCGCTTGCCATTTCCACCCG

AACGCTCCCATCTACAACGACCGCGAGCGTCTCCAGATATACATCTCT

GACGCTGGCGTCCTCTCCGTATGTTACGGTCTCTACCGTTACGCTGCT

TCGCGAGGAGTAGCCTCTGTGGTCTGTGTCTACGGAGTTCCGCTTCTA

ATTGTCAACTGTTTCCTCGTCTTGATCACTTACTTGCAGCACACGCAC

CCTTCGCTGCCTCACTATGATTCTTCCGAGTGGGATTGGTTGAGAGGA

GCTTTGGCTACTGTGGATAGAGACTATGGAATCTTGAACAAGGTGTTC
```
```
CATAACATCACGGACACGCACGTGGCGCATCATCTGTTCTCGACGATG

CCGCATTATAACGCGATGGAAGCGACCAAGGCGATAAAGCCGATACTT

TGGAGAGTATTACCAGTTTGATGGAACGCCGGCGGTTAAGGCGATGTG

GAGGGAGGCGAAGGAGTGTATCTATGTTGAACCGGATAGGCAAGGTGA

GAAGAAAGGTGTGTTCTGGTACAACAATAAGTTATGA
```

BnaA.FAD2.b-like is predicted to be a pseudogene, as there is a premature stop codon located at position 409-411 of SEQ ID NO:4.

The FAD2 gene copy BnaC.FAD2.b is located on chrC01 based on synteny of *B. napus* and its two progenitor species, *B. rapa* and *B. oleracea*. A representative example of the coding sequence for BnaC.FAD2.b is shown in SEQ ID NO:2:

```
                                        (SEQ ID NO:2)
ATGGGCGCAGGTGGAAGAATGCAAGTCTCTCCTCCCTCCAGCTCCCCC

GAAACCAAAACCCTCAAACGCGTCCCCTGCGAGACACCACCCTTCACT

CTCGGAGACCTCAAGAAAGCAATCCCACCTCACTGCTTCAAACGCTCC

ATCCCTCGCTCCTTCTCCTACCTCCTCTTCGACATCCTCGTCTCCTCC

TCCCTCTACCACCTCTCCACAGCCTACTTCCCTCTCCTCCCCCACCCT

CTCCCTTACCTCGCCTGGCCCCTCTACTGGGCCTGCCAAGGCTGCGTC

CTAACGGGCCTCTGGGTCATCGCCCACGAATGCGGCCACCACGCCTTC

AGCGACCACCAGTGGCTGGACGACGCCGTGGGCCTCGTCTTCCACTCC

TTCCTCCTCGTCCCTTACTTCTCCTGGAAGTACGGCCATCGACGCCAC

CATTCCAACACCGGATCCCTCGAGAGGGATGAAGTGCTCGTCCCCAAG

AAGAAATCCGACATCAAGTGGTACGGAAAGTACCTCAACAACCCGCTA

GGACGCACGGTGATGCTAACCGTCCAGTTCACGCTCGGCTGGCCGTTG

TACTTAGCCTTCAACGTCTCTGGAAGACCTTACAGCGACGGTTTCGCT

TGCCATTTCCACCCGAACGCTCCCATCTACAACGACCGCGAGCGTCTC

CAGATATACATCTCTGACGCTGGCGTCCTCTCCGTATGTTACGGTCTC

TACCGCTACGCTGGTTCGCGAGGAGTGGCCTCGATGGTCTGTGTCTAC

GGAGTTCCGCTTATGATTGTCAACTGTTTCCTCGTCTTGATCACTTAC

TTGCAGCACACGCACCCTTCGCTGCCTCACTATGATTCTTCGGAGTGG

GATTGGTTGAGAGGAGCTTTGGCTACTGTGGATAGAGACTATGGAATC

TTGAACAAGGTGTTTCATAACATCACGGACACGCACGTGGCGCATCAT

CTGTTCTCGACGATGCCGCATTATAACGCGATGGAAGCGACCAAGGCG

ATAAAGCCGATACTTGGAGAGTATTACCAGTTTGATGGAACGCCGGTG

GTTAAGGCGATGTGGAGGGAGGCGAAGGAGTGTATCTATGTTGAACCG

GATAGGCAAGGTGAGAAGAAAGGTGTGTTCTGGTACAACAATAAGTTA

TGA
```

The BnaC.FAD2.b gene produces a protein with conserved domains and signaling motifs. A first conserved domain includes the histidine-rich motif HECGHH (SEQ ID NO:35), encoded by nucleotides 313-330 of SEQ ID NO:2. A second conserved domain includes the histidine-rich motif HRRHH (SEQ ID NO:36), encoded by nucleotides 421-435 of SEQ ID NO:2. A third conserved domain includes the histidine-rich motif HVAHH (SEQ ID NO:37), encoded by nucleotides 946-960 of SEQ ID NO:2. A signaling motif responsible for allowing FAD2 to selectively bind to and embed in the endoplasmic reticulum (YNNKL; SEQ ID NO:38) is encoded by nucleotides 1138-1152 of SEQ ID NO:2.

Induced mutations within FAD2 gene copies, which can result in inactivation or attenuation of gene function; can include deletions, insertions, and substitutions. Deletions and insertions can range in size from one nucleotide (nt) to 200 or more nt (e.g., one to five nt, five to 10 nt, 10 to 15 nt, 15 to 20 nt, 20 to 30 nt, 30 to 40 nt, 40 to 50 nt, 50 to 75 nt, 75 to 100 nt, 100 to 150 nt, 150 to 200 nt, or more than 200 nt). A deletion may result in removal of 0.1% to 100% of a gene's coding sequence (e.g., 0.1 to 0.5%, 0.5 to 1%, 1 to 5%, 5 to 10%, 10 to 15%, 15 to 20%, 20 to 30%, 30 to 40%, 40 to 50%, 50 to 60%, 60 to 70%, 70 to 80%, 80 to 90%, or 90 to 100% of the coding sequence).

In some embodiments, deletions that result in inactivation or attenuation of gene function are frameshift mutations (i.e., −3N+1 and −3N+2, where N is a whole number that is greater than or equal to 1). In some embodiments, insertions that result in inactivation or attenuation are frameshift mutations (i.e., 3N−1 and 3N−2, where N is a whole number that is greater than or equal to 1). An inactivating/attenuating frameshift may occur within an exon, after the start codon and before the codon that encodes the last amino acid that is important for protein function. For the B. napus FAD2 gene copies, an inactivating/attenuating frameshift can occur before or within the nucleotides corresponding to nucleotides 313-330 of SEQ ID NO:1-3. In some cases, an inactivating/attenuating frameshift can occur before or within the nucleotides corresponding to nucleotides 421-435 of SEQ ID NO:1-3. In some cases, an inactivating/attenuating frameshift can occur before or within the nucleotides corresponding to nucleotides 946-960 of SEQ ID NO:1-3. In some cases, an inactivating/attenuating frameshift can occur before or within the nucleotides corresponding to nucleotides 1138-1152 of SEQ ID NO:1-3.

In some embodiments, deletions that can result in inactivation or attenuation of FAD2 gene function also may include in-frame deletions that remove codons encoding amino acids that are important for protein function. In some cases, for the B. napus FAD2 gene copies, an inactivating/attenuating in-frame deletion can be within or include the nucleotides corresponding to nucleotides 313-330 of SEQ ID NO:1-3. In some cases, an inactivating/attenuating in-frame deletion can be within or include the nucleotides corresponding to nucleotides 421-435 of SEQ ID NO:1-3. In some cases, an inactivating/attenuating in-frame deletion can be within or include the nucleotides corresponding to nucleotides 946-960 of SEQ ID NO:1-3. In some cases, an inactivating/attenuating in-frame deletion can be within or include the nucleotides corresponding to nucleotides 1138-1152 of SEQ ID NO:1-3.

To generate FAD2 mutants, B. napus cells can be transformed with one or more sequence-specific nucleases targeted to one or more of the FAD2 gene copies. Numerous independent mutants typically can be generated using each of one or more sequence-specific nucleases. Plants with specific FAD2 mutations also can be generated by crossing a first plant containing one or more sequence-specific nuclease-induced FAD2 mutations with a second plant that may or may not have one or more sequence-specific nuclease-induced FAD2 mutations. The resulting FAD2-mutant plants can be evaluated in any suitable way, including (1) phenotyping the desired trait (e.g., oil composition), (2) molecular characterization of the resulting plant(s) to ensure no off-target mutations or random integration of foreign DNA, (3) segregation of the mutation(s) and phenotype, and (4) agronomic performance of the FAD2-mutant plant(s).

Mutations in the different FAD2 gene copies can be combined. Different combination of mutations can result in different oil characteristics. In some embodiments, Brassica plants with one or more mutations in BnaA.FAD2.a can be generated. In some embodiments, Brassica plants with one or more mutations in BnaC.FAD2.a can be generated. In some embodiments, Brassica plants with one or more mutations in BnaC.FAD2.b can be generated. In some embodiments, Brassica plants with one or more mutations in BnaA.FAD2.a and BnaC.FAD2.a can be generated. In some embodiments, Brassica plants with one or more mutations in BnaA.FAD2.a and BnaC.FAD2.b can be generated. In some embodiments, Brassica plants with one or more mutations in BnaC.FAD2.a and BnaC.FAD2.b can be generated. In some embodiments, Brassica plants with one or more mutations in BnaC.FAD2.a, BnaC.FAD2.b, and BnaA.FAD2.a can be generated.

In some embodiments, a plant with one or more mutations in a FAD2 gene copy also can contain a transgene. The transgene can be integrated into the Brassica genome using standard transformation protocols. In some cases, the transgene can result in the expression of a protein that confers tolerance or resistance to one or more herbicides (e.g., glufonsinate, mesotrione, imidazolinone, isoxaflutole, glyphosate, 2,4-D, hydroxyphenylpyruvate dioxygenase-inhibiting herbicides, or dicamba). In some cases, the transgene can encode a plant 5-enolpyruvylshikimate-3-phosphate synthase (EPSPS) protein or a modified plant EPSPS protein, a bacterial EPSPS protein, where the modified plant EPSPS contains an amino acid substitution within the conserved TAMRP (SEQ ID NO:33) sequence. The substitution can include, for example, a threonine to isoleucine substitution, a proline to serine substitution, or a proline to adenine substitution. In some cases, the transgene can encode a bacterial EPSPS protein, an agrobacterium CP4 EPSPS protein, an aryloxyalkanoate dioxygenase (AAD) protein, a phosphinothricin N-acetyltransferase (PAT) protein, an acetohydroxyacid synthase large subunit protein, a p-hydroxyphenylpyruvate dioxygenase (hppd) protein, or a dicamba monooxygenase (DMO) protein.

In some cases, a nucleic acid can have a nucleotide sequence with at least about 75 percent sequence identity to a representative FAD2 nucleotide sequence. For example, a nucleotide sequence can have at least 75, at least 80, at least 85, at least 90, at least 91, at least 92, at least 93, at least 94, at least 95, at least 96, at least 97, at least 98, or at least 99 percent sequence identity to a representative FAD2 nucleotide sequence as set forth in any of SEQ ID NOS:1-4.

The percent sequence identity between a particular nucleic acid or amino acid sequence and a sequence referenced by a particular sequence identification number is determined as follows. First, a nucleic acid or amino acid sequence is compared to the sequence set forth in a particular sequence identification number using the BLAST 2 Sequences (B12seq) program from the stand-alone version of BLASTZ containing BLASTN version 2.0.14 and BLASTP version 2.0.14. This stand-alone version of BLASTZ can be obtained online at fr.com/blast or at ncbi.nlm.nih.gov. Instructions explaining how to use the B12seq program can be found in the readme file accompanying BLASTZ. B12seq performs a comparison between two sequences using either the BLASTN or BLASTP algorithm. BLASTN is used to compare nucleic acid sequences, while BLASTP is used to compare amino acid sequences. To compare two nucleic acid sequences, the options are set as follows: -i is set to a file containing the first nucleic acid sequence to be compared (e.g., C:\seq1.txt); -j is set to a file containing the second nucleic acid sequence to be compared (e.g., C:\seq2.txt); -p is set to blastn; -o is set to any desired file name (e.g., C:\output.txt); -q is set to -1; -r is set to 2; and all other options are left at their default setting. For example, the following command can be used to generate an output file containing a comparison between two sequences: C:\B12seq c:\seq1.txt -j c:\seq2.txt -p blastn -o c:\output.txt -q -1 -r 2. To compare two amino acid sequences, the options of B12seq are set as follows: -i is set to a file containing the first amino acid sequence to be compared (e.g., C:\seq1.txt); -j is set to a file containing the second amino acid sequence to be compared (e.g., C:\seq2.txt); -p is set to blastp; -o is set to any desired file name (e.g., C:\output.txt); and all other options are left at their default setting. For example, the following command can be used to generate an output file containing a comparison between two amino acid sequences: C:\B12seq c:\seq1.txt -j c:\seq2.txt -p blastp -o c:\output.txt. If the two compared sequences share homology, then the designated output file will present those regions of homology as aligned sequences. If the two compared sequences do not share homology, then the designated output file will not present aligned sequences.

Once aligned, the number of matches is determined by counting the number of positions where an identical nucleotide or amino acid residue is presented in both sequences. The percent sequence identity is determined by dividing the number of matches either by the length of the sequence set forth in the identified sequence (e.g., SEQ ID NO:1), or by an articulated length (e.g., 100 consecutive nucleotides or amino acid residues from a sequence set forth in an identified sequence), followed by multiplying the resulting value by 100. For example, an amino acid sequence that has 1100 matches when aligned with the sequence set forth in SEQ ID NO:1 is 95.2 percent identical to the sequence set forth in SEQ ID NO:1 (i.e., 1100/1155×100=95.2). It is noted that the percent sequence identity value is rounded to the nearest tenth. For example, 75.11, 75.12, 75.13, and 75.14 is rounded down to 75.1, while 75.15, 75.16, 7.17, 75.18, and 7.19 is rounded up to 7.2. It also is noted that the length value will always be an integer.

In some embodiments, the methods described herein involve the delivery of genome engineering reagents to canola (e.g., *B. napus*) plant cells. Any suitable method can be used to introduce the nucleic acid into the plant cell. In some embodiments, for example, a method as provided herein can include contacting a plant cell with an organism that is capable of horizontal gene transfer (e.g., a bacterium, such as an *Agrobacterium*), where the organism contains a Ti or Ri plasmid, or T-DNA plasmid having a T-DNA region that includes the promoter, UTRs, coding sequence, and a poly-A tail. Methods for *Agrobacterium*-mediated transformation in canola or *B. napus* are described elsewhere (see, e.g., Block et al., *Plant Physiol.* 91-694-701, 1989). In other embodiments, a method for introducing genome editing reagents as provided herein can include biolistic transformation, electroporation-mediated transformation, or polyethylene glycol-mediated transformation of *Brassica* plant cells (e.g., protoplasts). The protoplasts can be obtained from hypocotyl or leaf tissue. Plants containing mutations or TALE nuclease DNA can be regenerated using standard plant regeneration protocols. See, for example, Ali et al., *Pakistan Journal of Botany*, 39:1251, 2007; Lu et al., *Zeitschrift Pflanzenphysiologie*, 107:59-63, 1994; Hu et al., *Plant cell, tissue and organ culture*, 59:189-196, 1999. Nucleic acid can be delivered to *Brassica* protoplasts, where the nucleic acid is integrated into the host genome. Alternatively, nucleic acid can be delivered to *Brassica* protoplasts, where the nucleic acid does not integrate into the host genome, but instead remains extrachromosomal. Such transient delivery can result in protein expression from the nucleic acid sequence. If a sequence-specific nuclease is encoded by the delivered nucleic acid sequence, targeted mutations can be introduced into the *Brassica* cell without integration of the foreign nucleic acid sequence.

In some embodiments, the methods described herein can include determining the fatty acid composition within *B. napus* seed oil. Fatty acid composition can be determined using, for example, fatty acid methyl esters (FAME) gas chromatography (Beuselinck et al., *Crop Sci.* 47:747-750, 2006). FAME can be used to determine the levels of palmitic, stearic, oleic, linoleic and linolenic acid within *B. napus* seed oil.

In some embodiments, the methods provided herein can include identifying the intended gene edit. Any appropriate means can be employed to identify the desired targeted insertion. One suitable means is polymerase chain reaction (PCR), in which primers are designed to amplify DNA encompassing the TALE nuclease target site. The PCR product can be cloned and sequenced using standard DNA sequencing techniques. The sequencing results can be used to determine if the TALE nuclease target site includes mutations.

As used herein, the amino acid sequences follow the standard single letter or three letter nomenclature. All protein or peptide sequences are shown in conventional format where the N-terminus appears on the left and the carboxyl group at the C-terminus on the right. Amino acid nomenclature, both single letter and three letter, for naturally occurring amino acids are as follows: alanine (Ala; A), asparagine (Asn; N), aspartic acid (Asp; D), arginine (Arg; R), cysteine (Cys; C), glutamic acid (Glu; E), glutamine (Gin; Q), glycine (Gly; G), histidine (His; H), leucine (Leu; L), isoleucine (Ile; I), lysine (Lys; K), methionine (Met; M), phenylalanine (Phe; F), proline (Pro; P), serine (Ser; S), threonine (Thr; T), tryptophan (Trp; W), tyrosine (Tyr; Y), and valine (Val; V).

As used herein, "progeny" includes any plant, seed, plant cell, and/or a regenerated plant part having a non-naturally occurring mutation in the FAD2 gene copies derived from an ancestor plant. Progeny may contain non-naturally occurring mutations in one, two, three, or four of the FAD2 gene copies.

The term "allele(s)" means any of one or more alternative forms of a gene at a particular locus. In a diploid (or amphidiploid) cell of an organism, alleles of a given gene are located at a specific location or locus on a chromosome. One allele is present on each chromosome of the pair of homologous chromosomes. "Heterozygous" alleles are two different alleles residing at a specific locus, positioned individually on corresponding pairs of homologous chromosomes. "Homozygous" alleles are two identical alleles residing at a specific locus, positioned individually on corresponding pairs of homologous chromosomes in the cell. As used herein, "backcrossing" refers to a repetitive crossing of hybrid plants, where, for example, a first-generation hybrid is crossed back to one of the parents of the hybrid progeny. Backcrossing can be used to transfer one or more loci from one genetic background to a different genetic background.

As used herein, "crossing" refers to the mating of two parent plants, wherein the pollen of one parent is transferred to the stigma of the second parent. Crossing can be used to transfer one or more specific alleles to a different plant with a different genetic background. Crossing can be used to create a population of B. napus plants with a desired trait, where the population includes B. napus plants with different genetic backgrounds. Here, the B. napus plants of different genetic backgrounds are crossed to plants having an allele that produces a desired trait. Crossing, backcrossing and breeding can be carried out via known procedures. DNA fingerprinting, SNP or similar technologies may be used in a marker-assisted selection (MAS) breeding program to transfer or breed mutant FAD2 gene copies into other B. napus plants. For example, a breeder can create segregating populations from hybridizations of a genotype containing a mutant allele with an agronomically desirable genotype. Plants in the F2 or backcross generations can be screened using markers developed from FAD2 gene copy sequences or fragments thereof. Plants identified as possessing the mutant allele can be backcrossed or self-pollinated to create a second population to be screened. Depending on the expected inheritance pattern or the MAS technology used, it may be necessary to self-pollinate the selected plants before each cycle of backcrossing to aid identification of the desired individual plants. Backcrossing or other breeding procedure can be repeated until the desired phenotype of the recurrent parent is recovered. The result of a plant breeding program using the mutant B. napus plants described herein can be novel and useful lines and varieties. As used herein, the term "variety" refers to a population of plants that share constant characteristics which separate them from other plants of the same species. With respect to B. napus, a variety can refer to a population of B. napus plants with different genetic backgrounds. A variety is often, although not always, sold commercially. While possessing one or more distinctive traits, a variety can be further characterized by a very small overall variation between individuals within that variety. A "pure line" variety may be created by several generations of self-pollination and selection, or vegetative propagation from a single parent using tissue or cell culture techniques. A variety can be essentially derived from another line or variety. As defined by the International Convention for the Protection of New Varieties of Plants (Dec. 2, 1961, as revised at Geneva on Nov. 10, 1972, on Oct. 23, 1978, and on Mar. 19, 1991), a variety is "essentially derived" from an initial variety if: a) it is predominantly derived from the initial variety, or from a variety that is predominantly derived from the initial variety, while retaining the expression of the essential characteristics that result from the genotype or combination of genotypes of the initial variety; b) it is clearly distinguishable from the initial variety; and c) except for the differences which result from the act of derivation, it conforms to the initial variety in the expression of the essential characteristics that result from the genotype or combination of genotypes of the initial variety. Essentially derived varieties can be obtained, for example, by the selection of a natural or induced mutant, a somaclonal variant, a variant individual from plants of the initial variety, backcrossing, or transformation. A "line" as distinguished from a variety most often denotes a group of plants used non-commercially, for example in plant research. A line typically displays little overall variation between individuals for one or more traits of interest, although there may be some variation between individuals for other traits.

As used herein, the term "explant" refers to a section of plant cells or plant parts that are taken from a donor plant and used for culturing.

The term "increased oleic acid content" and "increased oleic content" refers to any increase in the oleic acid content from B. napus seed oil, as compared to the oleic acid content in a corresponding wild type B. napus seed oil. In some embodiments, the oleic acid content can be increased by at least 3% (e.g., at least 5%, at least 10%, at least 20%, at least 25%, at least 30%, at least 40%, at least 50%, at least 60%, at least 70%, at least 80%, or at least 90%), as compared to the oleic acid content in a corresponding wild type B. napus seed oil.

The term "reduced linoleic acid content" and "reduced linoleic content" refers to any reduction in the linoleic acid content from B. napus seed oil, as compared to the linoleic acid content in a corresponding wild type B. napus seed oil. In some embodiments, the linoleic acid content can be reduced by at least 3% (e.g., at least 5%, at least 10%, at least 20%, at least 25%, at least 30%, at least 40%, at least 50%, at least 60%, at least 70%, at least 80%, or at least 90%), as compared to the linoleic acid content in a corresponding wild type B. napus seed oil.

The term "reduced linolenic acid content" and "reduced linolenic content" refers to any reduction in the linolenic acid content from B. napus seed oil, as compared to the linolenic acid content in a corresponding wild type B. napus seed oil. In some embodiments, the linolenic acid content can be reduced by at least 3% (e.g., at least 5%, at least 10%, at least 20%, at least 25%, at least 30%, at least 40%, at least 50%, at least 60%, at least 70%, at least 8Y %, or at least 90%), as compared to the linolenic acid content in a corresponding wild type B. napus seed oil.

The term "induced mutation" as used herein refers to a mutation that was introduced by human intervention. An "induced mutation" can be a mutation that was introduced using one or more sequence-specific nucleases for example. The sequence-specific nuclease can be a meganuclease, TALE nuclease, zinc-finger nuclease, or CRISPR/Cas. An "induced mutation" also can be a mutation that was introduced using a chemical substance (e.g., ethylmethylsulfonate (EMS) or ethylnitrosourea (ENU)). In some embodiments, an "induced mutation" can be a mutation that was introduced using ionizing radiation such as neutrons (fast neutron mutagenesis), gamma rays, or X-rays.

"Wild type" as used herein refers to a typical form of a plant or a gene as it most commonly occurs in nature. For example, a "wild type FAD2 gene copy" is a naturally occurring FAD2 gene copy (e.g., as found within naturally occurring B. napus plants) that encodes a functional FAD2 protein, while a "mutant FAD2 gene copy" is a FAD2 gene copy that does not encode a functional FAD2 protein or encodes an attenuated FAD2 protein. Such a "mutant FAD2 gene copy" can include one or more mutations in its nucleic acid sequence, where the mutation(s) result in no detectable amount of the corresponding FAD2 protein activity in the plant, plant part or plant cell in vivo.

As used herein, the term "functional variant" is intended to refer to a catalytically active mutant of a protein or a protein domain. Such a mutant can have the same level of activity, or a higher or lower level of activity as compared to the parent protein or protein domain.

As used herein, "nuclear localization sequence" and "NLS" and "NLS tag" refer to an amino acid sequence that facilitates trafficking to the plant cell nucleus. Nuclear localization sequence and NLS and NLS tag can also refer to the nucleotide sequence that codes for an amino acid sequence that facilitates trafficking to the plant cell nucleus. An NLS tag can be located within the a protein sequence, or can be added to the C-terminus or N-terminus of a protein. Localization of an NLS tag near the N-terminus of a protein can be particularly useful.

As used herein, "deoxyribonucleic acid" and "DNA" refer to a biopolymer that includes nucleotides linked together by phosphodiester bridges. The four nucleotides include dAMP (2'-deoxyadenosine-5-monophosphate), dGMP (2'-deoxyguanosine-5-monophosphate), dCMP (2'-deoxycytosine-5-monophosphate) and dTMP (2'-deoxythymosine-5-monophosphate).

As used herein, the term "codon" refers to nucleotide triplets which code for amino acids. Due to the redundancy of the genetic code, the same amino acid can be coded for by different codons. The following is a list of amino acids and their respective codons: Met (ATG); Glu (GAA, GAG); Val (GTA, GTC, GTG, GTT); Arg (CGA, CGC, CGG, COT, AGA, AGG); Leu (CTA, CTC, CTG, CTT, TTA, TTG); Ser (TCA, TCC, TCG, TCT, AGC, AGT); Thr (ACA, ACC, ACG, ACT); Pro (CCA, CCC, CCG, CCT); Ala (GCT, GCA, GCC, GCG); Gly (GGA, GGC, GGG, GOT); Ile (ATA, ATC, ATT); Lys (AAA, AAG); Asn (AAC, AAT); Gin (CAG, CAA); His (CAC, CAT); Asp (GAC, GAT); Tyr (TAC, TAT); Cys (TGC, TGT); Phe (TTC, TTT); and Trp (UGG).

As used herein, the terms "plant" and "plant part" refer to cells, tissues, organs, seeds, and severed parts (e.g., roots, leaves, and flowers) that retain the distinguishing characteristics of the parent plant. "Seed" refers to any plant structure that is formed by continued differentiation of the ovule of the plant, following its normal maturation point at flower opening, irrespective of whether it is formed in the presence or absence of fertilization and irrespective of whether or not the seed structure is fertile or infertile.

As referred to herein, "coding sequence" or "CDS" refers to DNA that harbors the necessary information that is required to produce a functional RNA or protein. Coding sequence or CDS can include a DNA sequence starting with ATG and ending with a stop codon. The coding sequence or CDS usually does not contain introns, if no introns are required to produce the functional RNA or protein.

The term "rare-cutting endonucleases" herein refer to natural or engineered proteins having endonuclease activity directed to nucleic acid sequences having a recognition sequence (target sequence) about 12-40 bp in length (e.g., 14-40 bp in length). Typical rare-cutting endonucleases cause cleavage inside their recognition site, leaving 4 nt staggered cut with 3'OH or 5'OH overhangs. These rare-cutting endonucleases may be meganucleases, such as wild type or variant proteins of homing endonucleases, more particularly belonging to the dodecapeptide family (LAGLI-DADG (SEQ ID NO:34; see, WO 2004/067736) or may result from fusion proteins that associate a DNA binding domain and a catalytic domain with cleavage activity. TALE nucleases and zinc finger nucleases (ZFN) are examples of fusions of DNA binding domains with the catalytic domain of the endonuclease FokI. Customized TALE nucleases are commercially available under the trade name TALENT™ (Cellectis, Paris, France). For a review of rare-cutting endonucleases, see Baker, *Nature Methods* 9:23-26, 2012.

As referred to herein, "plant" can refer to crop plants, or monocots and dicots. Examples of a crop plants include soybean, wheat, alfalfa, canola, potato, rice, corn, millet, barley, tomato, apple, pear, strawberry, orange, watermelon, pepper, carrot, sugar beets, yam, lettuce, spinach, sunflower, and rape seed, a flowering plant, such as petunia, rose, and chrysanthemum, conifers and pine trees, a plant used in phytoremediation (e.g., heavy metal-accumulating plants), and a plant used for experimental purposes (e.g., *Arabidopsis*). The plant can be a monocot or a dicot. Examples of monocots include, without limitation, wheat, maize, rice, orchids, onion, aloe, true lilies, grasses (e.g., setaria), woody shrubs and trees (e.g., palms and bamboo), and food plants such as pineapple and sugar cane. Examples of dicots include, without limitation, tomato, cassava, soybean, tobacco, canola, potato, *Arabidopsis*, rose, pansy, sunflower, grape, strawberry, squash, bean, pea, and peanut. Orders of dicots include Magniolales, Illiciales, Laurales, Piperales, Aristochiales, Nymphaeales, Ranunculales, Papeverales, Sarraceniaceae, Trochodendrales, Hamamelidales, Eucomiales, Leitneriales, Myricales, Fagales, Casuarinales, Caryophyllales, Batales, Polygonales, Plumbaginales, Dilleniales, Theales, Malvales, Urticales, Lecythidales, Violales, Salcicales, Capparales, Ericales, Diapensales, Ebenales, Primulales, Rosales, Fabales, Podostemales, Halorgales, Myrtales, Cornales, Proteales. San tales, Rafflesiales. Celastrales, Euphorbiales. Rhamnales, Sapindales, Juglandales, Geraniales, Polygalales, Umbellales, Gentianales, Polemoniales, Lamiales, Plantaginales, Scrophulariales, Camapnulales, Rubiales, Dipsacales, and Asterales. Genera of dicots include *Atropa, Alseodaphne, Anacardium, Arachis, Beilschmiedia, Brassica, Carthamus, Cocculus, Croton, Cucumis, Citrus, Citrullus, Capsicum, Catharanthus, Cocos, Coffea, Cucurbita, Daucus, Duguetia, Eschscholzia, Ficus, Fragaria, Galucium. Glycine, Gossypium, Helianthus, Hevea, Hyoscyamus, Lactuca, Landolphia, Linum, Litsea, Lycopersicon, Lupinus, Manihot, Majorana, Malus, Medicago, Nicotiana, Olea, Parthenium, Papaver, Persea, Phaseolus, Pistacia, Pisum, Pyrus, Prunus, Raphanus, Ricinus, Senecio, Sinomenium, Stephania, Sinapsis, Solanum, Theobroma, Trifolium, Trigonella, Vicia, Vinca, Vilis,* and *Vigna.* Orders of monocots include Alismatales, Hydrocharitales, Najadales, Triuridales, Commelinales, Eriocaulales, Restionales, Poales, Juncales, Cyperales, Typhales, Bromeliales, Zingiberales, Arecales, Cyclanthales, Pandanales, Arales, Lilliales, and Orchid ales. Genera of monocots include *Allium, Andropogon, Aragrostis, Asparagus, Avena, Cynodon, Elaeis, Festuca, Festulolium, Heterocallis, Hordeum, Lemna, Lolium, Musa, Oryza, Panicum, Pannesetum, Phleum, Poa, Secale, Sorghum, Triticum,* and *Zea.* Other plants include Gymnospermae, such as the orders Pinales, Ginkgoales, Cycadales, and Gnetales, such as the genera *Abies, Cunninghamia, Picea, Pinus,* and *Pseudotsuga,* such as fir and pine.

"Mutagenesis" as used herein refers to processes in which mutations are introduced into a selected DNA sequence. Mutations induced by endonucleases generally are obtained by a double-strand break, which results in insertion/deletion mutations ("indels") that can be detected by deep-sequencing analysis. Such mutations typically are deletions of several base pairs, and have the effect of inactivating the mutated allele. In the methods described herein, for example, mutagenesis occurs via double-stranded DNA breaks made by nucleases targeted to selected DNA sequences in a plant cell. Such mutagenesis results in "nuclease-induced mutations" (e.g., nuclease-induced knockouts, such as TALE-nuclease-induced knockouts) and reduced expression of the targeted gene. Following mutagenesis, plants can be regenerated from the treated cells using known techniques (e.g., planting seeds in accordance with conventional growing procedures, followed by self-pollination).

Methods for selecting endogenous target sequences and generating TALE nuclease pairs targeted to such sequences can be performed as described elsewhere. See, for example, PCT Publication No. WO 2011/072246, which is incorporated herein by reference in its entirety. In some embodiments, software that specifically identifies TALE nuclease recognition sites, such as TALE-NT 2.0 (Doyle et al., *Nucl Acids Res* 40:W117-122, 2012) can be used.

Transcription activator-like (TAL) effectors are found in plant pathogenic bacteria of the genus *Xanthomonas*. These proteins play important roles in disease, or trigger defense, by binding host DNA and activating effector-specific host genes (see, e.g., Gu et al., *Nature* 435:1122-1125, 2005; Yang et al., *Proc Nat Acad Sci USA* 103:10503-10508, 2006; Kay et al., *Science* 318:648-651, 2007; Sugio et al., *Proc Natl Acad Sci USA* 104:10720-10725, 2007; and RSmer et al., *Science* 318:645-648, 2007). Specificity depends on an effector-variable number of imperfect, typically 34 amino acid repeats (Schornack et al., *J Plant Physiol* 163:256-272, 2006; and WO 2011/072246). Polymorphisms are present primarily at repeat positions 12 and 13, which are referred to as the repeat variable-diresidue (RVD).

The RVDs of TALEs correspond to the nucleotides in their target sites in a direct, linear fashion, one RVD to one nucleotide, with some degeneracy and no apparent context dependence. This mechanism for protein-DNA recognition enables target site prediction for new target specific TALEs, as well as target site selection and engineering of new TALEs with binding specificity for the selected sites.

TALE DNA binding domains can be fused to other sequences, such as endonuclease sequences, resulting in chimeric endonucleases targeted to specific, selected DNA sequences, and leading to subsequent cutting of the DNA at or near the targeted sequences. Such cuts (i.e., double-stranded breaks) in DNA can induce mutations into the wild type DNA sequence via non-homologous end joining (NHEJ) or homologous recombination, for example. In some cases, TALE nucleases can be used to facilitate site directed mutagenesis in complex genomes, knocking out or otherwise altering gene function with great precision and high efficiency. As described in the Examples below, TALE nucleases targeted to *B. napus* FAD2 gene copies can be used to mutagenize the endogenous alleles, resulting in plants without detectable activity of the corresponding FAD2 protein, or attenuated activity. Some endonucleases (e.g., FokI) function as dimers and can be used to enhance the target specificity of the TALE nuclease. For example, in some cases a pair of TALE nuclease monomers targeted to different DNA sequences can be used. When the two TALE nucleases recognition sites are in close proximity, the inactive monomers can come together to create a functional enzyme that cleaves the DNA. By requiring DNA binding to activate the nuclease, a highly site-specific restriction enzyme can be created.

Methods for using TALE nucleases to generate *Brassica* plants, plant cells, or plant parts having mutations in endogenous genes include, for example, those described in the Examples herein. For example, one or more nucleic acids encoding TALE nucleases targeted to conserved nucleotide sequences present in one or more FAD2 gene copies can be transformed into plant cells or plant parts, where they can be expressed. In some cases, one or more TALE nuclease proteins can be introduced into plant cells or plant parts. The cells or plant parts, or a plant cell line or plant part generated from the cells, can subsequently be analyzed to determine whether mutations have been introduced at the target site(s), through next-generation sequencing techniques (e.g., 454 pyrosequencing or illumina sequencing) or conventional sequencing methods (e.g., Sanger sequencing). The template for sequencing can be, for example, the TALE nuclease target site within a FAD2 gene copy.

RNA-guided systems also can be used in the methods provided herein. For example, the clustered regularly interspaced short palindromic repeats/CRISPR-associated (CRISPR/Cas) systems use RNA to direct DNA cleavage (see, e.g., Belahj et al., *Plant Methods* 9:39, 2013). This system consists of a Cas9 endonuclease and a guide RNA (either a complex between a CRISPR RNA [crRNA] and trans-activating crRNA [tracrRNA], or a synthetic fusion between the 3' end of the crRNA and 5'end of the tracrRNA). The guide RNA directs Cas9 binding and DNA cleavage to sequences that are adjacent to a proto-spacer adjacent motif (PAM; e.g., NGG for Cas9 from *Streptococcus pyogenes*). Once at the target DNA sequence, Cas9 generates a DNA double-strand break at a position three nucleotides from the 3' end of the crRNA sequence that is complementary to the target sequence. As there are several PAM motifs present in the nucleotide sequence of the FAD2 gene copies, the CRISPR/Cas system may be employed to introduce mutations within the FAD2 gene copies within *B. napus* plant cells in which the Cas9 endonuclease and the guide RNA are transfected and expressed. This approach can be used as an alternative to TALE nucleases in some instances, to obtain plants and plant parts as described herein.

The term "expression" as used herein refers to the transcription of a particular nucleic acid sequence to produce sense or antisense RNA or mRNA, and/or the translation of an mRNA molecule to produce a polypeptide, with or without subsequent post-translational events.

The term "modulating" as used herein refers to increasing or decreasing translational efficiency of an mRNA. This can be accomplished by inserting, removing, or altering a 5' UTR sequence, a 3' UTR sequence, or 5' and 3' UTR sequences.

As used herein, the term "nucleic acid" refers to a polymer made up of nucleotide monomers. A nucleic acid can be single stranded or double stranded, and can be linear or circular. Where single-stranded, a nucleic acid can be a sense strand or an antisense strand. A nucleic acid can be composed of DNA (e.g., cDNA, genomic DNA, synthetic DNA, or a combination thereof), RNA, or DNA and RNA. Further, nucleic acids can contain information for gene expression, including, but not limited to, promoters, 5' UTRs, 3' UTRs, coding sequences, and terminators.

A "vector" is a replicon, such as a plasmid, phage, or cosmid, into which another DNA segment may be inserted so as to bring about the replication of the inserted segment. Generally, a vector is capable of replication when associated with the proper control elements. Suitable vector backbones include, for example, those routinely used in the art such as plasmids, viruses, artificial chromosomes, BACs, YACs, or PACs. The term "vector" includes cloning and expression vectors, as well as viral vectors and integrating vectors. An "expression vector" is a vector that includes one or more expression control sequences, and an "expression control sequence" is a DNA sequence that controls and regulates the transcription and/or translation of another DNA sequence. Suitable expression vectors include, without limitation, plasmids and viral vectors derived from, for example, bacteriophage, baculoviruses, tobacco mosaic virus, herpes viruses, cytomegalovirus, retroviruses, vaccinia viruses, adenoviruses, and adeno-associated viruses. Numerous vectors and expression systems are commercially available from such corporations as Novagen (Madison, Wis.), Clontech (Palo Alto, Calif.), Stratagene (La Jolla, Calif.), and Invitrogen/Life Technologies (Carlsbad, Calif.).

The terms "regulatory region," "control element," and "expression control sequence" refer to nucleotide sequences that influence transcription or translation initiation and rate, and stability and/or mobility of the transcript or polypeptide product. Regulatory regions include, without limitation, promoter sequences, enhancer sequences, response elements, protein recognition sites, inducible elements, promoter control elements, protein binding sequences, 5' and 3' UTRs, transcriptional start sites, termination sequences, polyadenylation sequences, introns, and other regulatory regions that can reside within coding sequences, such as secretory signals, Nuclear Localization Sequences (NLS) and protease cleavage sites.

As used herein, "operably linked" means incorporated into a genetic construct so that expression control sequences effectively control expression of a coding sequence of interest. A coding sequence is "operably linked" and "under the control" of expression control sequences in a cell when RNA polymerase is able to transcribe the coding sequence into RNA, which if an mRNA, then can be translated into the protein encoded by the coding sequence. Thus, a regulatory region can modulate, e.g., regulate, facilitate or drive, transcription in the plant cell, plant, or plant tissue in which it is desired to express a modified target nucleic acid.

In addition, in some embodiments in which a plant part or plant cell is used, the methods provided herein can include regenerating a plant from the plant part or plant cell. The methods also can include breeding the plant (e.g., the plant into which the nucleic acids were introduced, or the plant obtained after regeneration of the plant part or plant cell used as a starting material) to obtain a genetically desired plant lineage. Methods for regenerating and breeding plants are well established in the art.

The invention will be further described in the following examples, which do not limit the scope of the invention described in the claims.

EXAMPLES

Example 1—Design of TALE Nucleases Targeting FAD2 Genes in *B. napus*

To identify potential target sequences for TALE nucleases, the FAD2 genes were sequenced. To this end, publicly available coding sequences for the FAD2 loci in canola were downloaded from NCBI. See, SEQ ID NOS:1-4 for the coding sequences of BnaA.FAD2.a, BnaC.FAD2.b, BnaCFAD2.a and BnaA.FAD2.b-like. Primers were designed to amplify the coding sequences of BnaA.FAD2.a, BnaC.FAD2.b, and BnaC.FAD2.a in two *B. napus* spring cultivars, Westar and Topas. Primers are shown in TABLE 1.

TABLE 1

Primers for sequencing the *Brassica napus* FAD2 genes

| Primer name | Description | Sequence | SEQ ID NO: |
|---|---|---|---|
| BnFAC1Fa | FAD2.a forward | CAGGATCCATGGGTGCAGG TGGAAGAAT | 5 |
| BnFAC1Fb | FAD2.b forward | CAGGATCCATGGGCGCAGG TGGAAGAAT | 6 |
| BnFAC1R | FAD2 reverse | CAGAGCTCTCATAACTTAT TGTTGTACCAG | 7 |

DNA was extracted from *B. napus* spring cultivars, Westar and Topas, using standard CTAB-based methods (Murray and Thompson, *Nucl Acids Res*, 8:4321-4325, 1980). Primers shown in TABLE 1 were used to amplify the FAD2 gene copies. Resulting PCR amplicons were cloned and sequenced. Sequences were aligned and a consensus sequence for the FAD2 gene copies was elucidated.

Seven TALE nucleases were designed to target sequence near the 5' end of the FAD2 coding sequence. TALE nucleases were designed to target sequence upstream of one or more sites which encode conserved amino acids (e.g., HECGHH [SEQ ID NO:35], HRRHH [SEQ ID NO:36], HVAHH [SEQ ID NO:37]. YNNKL [SEQ ID NO:38]). Due to differences in nucleotide sequences between the copies of the FAD2 genes, TALE nucleases could not be designed to target a conserved sequence between the FAD2 gene copies. Instead, TALE nucleases were designed to target either one or two of the copies of the FAD2 gene copies.

The seven TALE nuclease pairs were named BnFAD2_T01, BnFAD2_T02, BnFAD2_T03, BnFAD2_T04, BnFAD2_T05, BnFAD2_T06, and BnFAD2_T07. A listing of the TALE nucleases and predicted binding sites are shown in TABLE 2.

TABLE 2

Individual TALE nuclease target sequences

| TALE nuclease target | Target sequence | SEQ ID NO: |
|---|---|---|
| BnFAD2_T01 | TCCCTCACCCTCTCTCCTACTTCGCCTGGC CTCTCTACTGGGCCTGCCA | 8 |
| BnFAD2_T02 | TCGTCCCTTACTTCTCCTGGAAGTACAGTC ATCGACGCCACCATTCCAA | 9 |
| BnFAD2_T03 | TGCGAGACACCGCCCTTCACTGTCGGAGAA CTCAAGAAAGCAATCCCA | 10 |
| BnFAD2_T04 | TACCTCATCTGGGACATCATCATAGCCTCC TGCTTCTACTACGTCGCCA | 11 |
| BnFAD2_T05 | TCTGGGTCATAGCCCACGAGTGCGGCCACC ACGCCTTCAGCGACTACCA | 12 |
| BnFAD2_T06 | TCCTTCTCCTACCTCCTCTTCGACATCCTC GTCTCCTCCTCCCTCTACCA | 13 |
| BnFAD2_T07 | TCTGGGTCATCGCCCACGAATGCGGCCACC ACGCCTTCAGCGACCACCA | 14 |

Differences in nucleotide sequences between the FAD2 gene copies prevented the design of TALE nucleases which target a conserved sequence across all FAD2 gene copies. A list of the predicted TALE nuclease binding sequences within each FAD2 gene copy for each TALE nuclease pair is shown in TABLES 3-9.

TABLE 3

Predicted binding sequences for BnFAD2_T01 within the four FAD2 gene copies

| FAD2 target | Predicted binding sequence for BnFAD2_T01 | SEQ ID NO: |
|---|---|---|
| BnaA.FAD2.a | TCCCTCACCCTCTCTCCTACTTCGCCTGGC CTCTCTACTGGGCCTGCCA | 8 |
| BnaC.FAD2.a | TCCCTCACCCTCTCTCCTACTTCGCCTGGC CTCTCTACTGGGCCTGCCA | 8 |

TABLE 3-continued

Predicted binding sequences for BnFAD2_T01 within the four FAD2 gene copies

| FAD2 target | Predicted binding sequence for BnFAD2_T01 | SEQ ID NO: |
|---|---|---|
| BnaC.FAD2.b | TCCCCCACCCTCTCCCTTACCTCGCCTGGC CCCTCTACTGGGCCTGCCA | 15 |
| BnaA.FAD2.b-like | CTTACCTCGCCTGACCCCTCTACTGGGCCT GCCA | 16 |

TABLE 4

Predicted binding sequences for BnFAD2_T02 within the four FAD2 gene copies

| FAD2 target | Predicted binding sequence for BnFAD2_T01 | SEQ ID NO: |
|---|---|---|
| BnaA.FAD2.a | TCGTCCCTTACTTCTCCTGGAAGTACAGTCA TCGACGCCACCATTCCAA | 9 |
| BnaC.FAD2.a | TCGTCCCTTACTTCTCCTGGAAGTACAGTCA TCGACGCCACCATTCCAA | 9 |
| BnaC.FAD2.b | TCGTCCCTTACTTCTCCTGGAAGTACGGCCA TCGACGCCACCATTCCAA | 17 |
| BnaA.FAD2.b-like | TCGTCCCGTACTTCTCCTGGAAGTACATCCA TGACGCCACCATTCCAA | 18 |

TABLE 5

Predicted binding sequences for BnFAD2_T03 within the four FAD2 gene copies

| FAD2 target | Predicted binding sequence for BnFAD2_T01 | SEQ ID NO: |
|---|---|---|
| BnaA.FAD2.a | TGCGAGACACCGCCCTTCACTGTCGG AGAACTCAAGAAAGCAATCCCA | 10 |
| BnaC.FAD2.a | TGCGAGACACCGCCCTTCACTGTCGG AGAACTCAAGAAAGCAATCCCA | 10 |
| BnaC.FAD2.b | TGCGAGACACCACCCTTCACTCTCGG AGACCTCAAGAAAGCAATCCCA | 19 |
| BnaA.FAD2.b-like | TGCGAGACACCACCATTCACTCTCGG AGACCTCAAGAAAGCAATCCCA | 20 |

TABLE 6

Predicted binding sequences for BnFAD2_T04 within the four FAD2 gene copies

| FAD2 target | Predicted binding sequence for BnFAD2_T01 | SEQ ID NO: |
|---|---|---|
| BnaA.FAD2.a | TACCTCATCTGGGACATCATCATAGC CTCCTGCTTCTACTACGTCGCCA | 11 |
| BnaC.FAD2.a | TACCTCATCTGGGACATCATCATAGC CTCCTGCTTCTACTACGTCGCCA | 11 |
| BxaC.FAD2.b | TACCTCCTCTTCGACATCCTCGTCTC CTCCTCCCTCTACCACCTCTCCA | 21 |

TABLE 6-continued

Predicted binding sequences for BnFAD2_T04 within the four FAD2 gene copies

| FAD2 target | Predicted binding sequence for BnFAD2_T01 | SEQ ID NO: |
|---|---|---|
| BnaA.FAD2.b-like | TCTTCGACATCATCATCTCCTCCTCG GCTCCTCCCTCTACCACCTCTCCA | 22 |

TABLE 7

Predicted binding sequences for BnFAD2_T05 within the four FAD2 gene copies

| FAD2 target | Predicted binding sequence for BnFAD2_T01 | SEQ ID NO: |
|---|---|---|
| BnaA.FAD2.a | TCTGGGTCATAGCCCACGAGTGCGGC CACCACGCCTTCAGCGACTACCA | 12 |
| BnaC.FAD2.a | TCTGGGTCATAGCCCACGAGTGCGGC CACCACGCCTTCAGCGACTACCA | 12 |
| BnaC.FAD2.b | TCTGGGTCATCGCCCACGAATGCGGC CACCACGCCTTCAGCGACCACCA | 14 |
| BnaA.FAD2.b-like | TCTGGGTCATAGCCCACGAGTGCGGC CACCACGCCTTCAGCGACCACCA | 23 |

TABLE 8

Predicted binding sequences for BnFAD2_T06 within the four FAD2 gene copies

| FAD2 target | Predicted binding sequence for BnFAD2_T01 | SEQ ID NO: |
|---|---|---|
| BnaA.FAD2.a | TCTTTCTCCTACCTCATCTGGGACAT CATCATAGCCTCCTGCTTCTACTA | 24 |
| BnaC.FAD2.a | TCTTTCTCCTACCTCATCTGGGACAT CATCATAGCCTCCTGCTTCTACTA | 25 |
| BnaC.FAD2.b | TCCTTCTCCTACCTCCTCTTCGACAT CCTCGTCTCCTCCTCCCTCTACCA | 13 |
| BnaA.FAD2.b-like | TCCTTCTCCTCTTCGACATCATCATC TCCTCCTCGGCTCCTCCCTCTACCA | 26 |

TABLE 9

Predicted binding sequences for BnFAD2_T07 within the four FAD2 gene copies

| FAD2 target | Predicted binding sequence for BnFAD2_T01 | SEQ ID NO: |
|---|---|---|
| BnaA.FAD2.a | TCTGGGTCATAGCCCACGAGTGCGGC CACCACGCCTTCAGCGACTACCA | 27 |
| BnaC.FAD2.a | TCTGGGTCATAGCCCACGAGTGCGGC CACCACGCCTTCAGCGACTACCA | 28 |
| BnaC.FAD2.b | TCTGGGTCATCGCCCACGAATGCGGC CACCACGCCTTCAGCGACCACCA | 14 |
| BnaA.FAD2.b-like | TCTGGGTCATAGCCCACGAGTGCGGC CACCACGCCTTCAGCGACCACCA | 29 |

Example 2—Assessing the Activity of TALE Nucleases Targeting FAD2 Gene Copies

To assess the activity of the FAD2-targeting TALE nuclease pairs, a protoplast transformation experiment was performed. Brassica protoplasts were isolated from leaves of plants grown in vitro. Plants (B. napus cv. Westar) were grown in vitro for 3-4 weeks before leaves were collected. Leaves were digested in an enzyme solution containing 0.25% cellulase and 0.05% macerozyme. The enzyme solution was placed in a 25 C incubator and shaken at 25 rpm for approximately 16 hours. Following digestion, protoplasts were isolated using conventional protoplast isolation techniques with some modification. Specifically, protoplasts were filtered through a 100 um cell strainer into a 50 mL conical tube. Cells were pelleted by centrifugation at 100 g for 5 minutes and washed by W5 solution for three times. After washing, cell pellet was resuspended in an MMG solution, then protoplasts (100,000 per sample) were transformed in a solution containing 20% polyethylene glycol and 30 ug of TALE nuclease-encoded plasmid DNA (i.e., 15 ug of plasmid encoding each TALE nuclease monomer). Following transformation, cells were washed one time in W5. After the wash, cells were resuspended in K8P solution and incubated at 25° C. Two days post transformation, protoplasts were collected and DNA was extracted. TALE nuclease target sites were amplified by PCR, and the resulting amplicons were deep sequenced using illumina sequencing. Primers used to amplify the TALE nuclease target sequences are shown in TABLE 10.

TABLE 10

Oligo names and binding sequences for illumina sequencing

| Oligo name | Binding sequence | SEQ ID NO: |
|---|---|---|
| BnFAC1Fa-HTS | CAGGATCCATGGGTGCAGGTGGAAGAAT | 5 |
| BnFA353R-HTS | GGTAGTCGCTGAAGGCGTGGT | 30 |
| BnFA231F-HTS | CCTCTCCTCCCTCACCCTCTC | 31 |
| BnFA591R-HTS | GCTAAGTACAAAGGCCAGCCGAG | 32 |

Mutation frequencies of TALE nuclease pairs were assessed for activity at the FAD2 gene copies. Mutation frequencies were calculated by dividing the number of mutant sequences by the total number of sequences. Reads were grouped by the corresponding FAD2 gene copy before mutation frequencies were calculated. The mutation frequencies for all TALE nuclease pairs are shown in TABLE 11.

TABLE 11

TALE nuclease mutation frequencies at FAD2

| TALE nuclease pair | FAD2 target | # of events | Total reads | Mutagenesis frequency (%) |
|---|---|---|---|---|
| BnFAD2_T01 | BnaA.FAD2.a | 8065 | 96878 | 8.3 |
| BnFAD2_T01 | BnaC.FAD2.b | 3062 | 159046 | 1.9 |
| BnFAD2_T01 | BnaC.FAD2.a | 7936 | 78825 | 10 |
| BnFAD2_T02 | BnaA.FAD2.a | 10003 | 102684 | 9.7 |
| BnFAD2_T02 | BnaC.FAD2.b | 5030 | 91948 | 5.5 |
| BnFAD2_T02 | BnaC.FAD2.a | 5870 | 57266 | 10.3 |
| BnFAD2_T03 | BnaA.FAD2.a | 9229 | 102038 | 9 |

TABLE 11-continued

TALE nuclease mutation frequencies at FAD2

| TALE nuclease pair | FAD2 target | # of events | Total reads | Mutagenesis frequency (%) |
|---|---|---|---|---|
| BnFAD2_T03 | BnaC.FAD2.b | 15617 | 156185 | 10 |
| BnFAD2_T03 | BnaC.FAD2.a | 6614 | 67230 | 9.8 |
| BnFAD2_T04 | BnaA.FAD2.a | ND | ND | ND |
| BnFAD2_T04 | BnaC.FAD2.b | ND | ND | ND |
| BnFAD2 T04 | BnaC.FAD2.a | ND | ND | ND |
| BnFAD2 T05 | BnaA.FAD2.a | 3010 | 78379 | 3.8 |
| BuFAD2_T05 | BnaC.FAD2.b | 1549 | 67387 | 23 |
| BnFAD2_T05 | BnaC.FAD2.a | 2114 | 48613 | 4.4 |
| BnFAD2_T06 | BnaA.FAD2.a | ND | ND | ND |
| BnFAD2_T06 | BnaC.FAD2.b | ND | ND | ND |
| BnFAD2_T06 | BnaC.FAD2.a | ND | ND | ND |
| BuFAD2_T07 | BnaA.FAD2.a | 1904 | 85910 | 2.2 |
| BnFAD2_T07 | BnaC.FAD2.b | 1492 | 57404 | 2.6 |
| BnFAD2_T07 | BnaC.FAD2.a | 1154 | 41932 | 2.8 |

FAD2 mutations within Brassica cells were further analyzed. Both insertions and deletions were observed, with the majority being deletions. With respect to TALE nuclease pair BnFAD2_T01, the majority of mutations resulted in deletion of a specific nucleotide within the TALE nuclease target sequence. For TALE nuclease pair BnFAD2_T01, a deletion of the guanine at position 253 of SEQ ID NOS:1, 2 and 3 was observed in the majority of mutations.

With respect to TALE, nuclease pair BnFAD2_T02, the majority of mutations resulted in deletion of a specific nucleotide within the TALE nuclease target sequence. For TALE nuclease pair BnFAD2_T02, a deletion of the adenine at position 416 of SEQ ID NOS:1, 2 and 3 was observed in the majority of mutations.

With respect to TALE nuclease pair BnFAD2_T03, the majority of mutations resulted in deletion of a specific nucleotide within the TALE nuclease target sequence. For TALE nuclease pair BnFAD2_T03, a deletion of the adenine at position 99 of SEQ ID NOS:1, 2 and 3 was observed in the majority of mutations.

With respect to TALE, nuclease pair BnFAD2_T05, the majority of mutations resulted in deletion of a specific nucleotide within the TALE nuclease target sequence. For TALE nuclease pair BnFAD2_T05, a deletion of the guanine at position 322 of SEQ ID NOS:1, 2 and 3 was observed in the majority of mutations.

With respect to TALE nuclease pair BnFAD2_T07, the majority of mutations resulted in deletion of a specific nucleotide within the TALE nuclease target sequence. For TALE nuclease pair BnFAD2_T07, a deletion of the guanine at position 322 of SEQ ID NOS:1, 2 and 3 was observed in the majority of mutations.

A list of FAD2 sequences containing TALE nuclease-induced mutations, both insertions and deletions, identified within Brassica cells is provided within SEQ ID NOS:39-53891.

Examples of induced mutations within BnaA.FAD2.a using TALE nuclease pair BnFAD2_T01 are shown within SEQ ID NOS:2533-7234.

Examples of induced mutations within BnaC.FAD2.a using TALE nuclease pair BnFAD2_T01 are shown within SEQ ID NOS:7235-11755.

Examples of induced mutations within BnaC.FAD2.b using TALE nuclease pair BnFAD2_T01 are shown within SEQ ID NOS:39-2532.

Examples of induced mutations within BnaA.FAD2.a using TALE nuclease pair BnFAD2_T02 are shown within SEQ ID NOS:11756-18467.

Examples of induced mutations within BnaC.FAD2.a using TALE nuclease pair BnFAD2_T02 are shown within SEQ ID NOS:18468-22172.

Examples of induced mutations within BnaC.FAD2.b using TALE nuclease pair BnFAD2_T02 are shown within SEQ ID NOS:22173-25734.

Examples of induced mutations within BnaA.FAD2.a using TALE nuclease pair BnFAD2_T03 are shown within SEQ ID NOS:25735-31174.

Examples of induced mutations within BnaC.FAD2.a using TALE nuclease pair BnFAD2_T03 are shown within SEQ ID NOS:31175-35193.

Examples of induced mutations within BnaC.FAD2.b using TALE nuclease pair BnFAD2_T03 are shown within SEQ ID NOS:35194-46067.

Examples of induced mutations within BnaA.FAD2.a using TALE nuclease pair BnFAD2_T05 are shown within SEQ ID NOS:46068-48123.

Examples of induced mutations within BnaC.FAD2.a using lease pair BnFAD2_T05 are shown within SEQ ID NOS:48124-49475.

Examples of induced mutations within BnaC.FAD2.b using TALE nuclease pair BnFAD2_T05 are shown within SEQ NOS:49476-50588.

Examples of induced mutations within BnaA.FAD2.a using TALE nuclease pair BnFAD2_T07 are shown within SEQ ID NOS:50589-52024.

Examples of induced mutations within BnaC.FAD2.a using TALE nuclease pair BnFAD2_T07 are shown within SEQ ID NOS:52025-52787.

Examples of induced mutations within BnaC.FAD2.b using TALE nuclease pair BnFAD2_T07 are shown within SEQ ID NOS:52788-53891.

Example 3—Regenerating *B. napus* Plants with Mutations in FAD2 Gene Copies

To regenerate *Brassica* plants having mutations within the FAD2 gene, protoplasts were transformed with DNA encoding functional TALE nuclease BnFAD2_T03 and regenerated into whole plants. *Brassica* protoplasts were isolated from leaves of plants grown in vitro. Plants (*B. napus* cv, Westar) were grown in vitro for 3-4 weeks before leaves were collected. Leaves were digested in an enzyme solution containing 0.25% cellulase and 0.05% macerozyme. The enzyme solution was placed in a 25° C. incubator and shaken at 25 rpm for about 16 hours. Following digestion, protoplasts were isolated using conventional protoplast isolation techniques with some modification. Specifically, protoplasts were filtered through a 100 μm cell strainer into a 50 mL, conical tube. Cells were pelleted by centrifugation at 100 g for 5 minutes and washed by W5 solution for three times. After washing, cell pellet was resuspended in an MMG solution, then protoplasts (100,000 per sample) were transformed in a solution containing 20% polyethylene glycol and 30 gg of TALE nuclease-encoded plasmid DNA (15 ug of plasmid encoding each TALE nuclease monomer). Following transformation, cells were washed one time in W5. After the wash, cells were resuspended in K8P solution and incubated at 25° C.

Plants were regenerated from protoplasts using conventional *B. napus* regeneration techniques; see, for example, Ali et al., *Pakistan Journal of Botany*, 39:1251, 2007; Lu et al., *Zeitschrift für Pflanzenphysiologie*, 107:59-63, 1994; flu et al., *Plant Cell, Tissue and Organ Culture*, 59:189-196, 1999.

Individual *B. napus* plants regenerated from protoplasts were then advanced to molecular screening.

Example 4—Screening *Brassica* Plants for Mutations in FAD2 Gene Copies

DNA was extracted from *Brassica* plants using standard CTAB-based methods (Murray and Thompson, *Nucl Acids Res*, 8:4321-4325, 1980). Target sites for BnFAD2_T03 TALE nuclease pair were amplified by PCR, and the resulting amplicons were deep sequenced using Illumina sequencing. Primers used to amplify the BnFAD2_T03 TALE nuclease target sequences are shown in TABLE. 10.

Plant c02 had a 4 bp deletion in BnaC.FAD2.a (FIG. 2). The 4 bp deletion corresponded to nucleotides 252-255 of SEQ ID NO:3; the region with the 4 bp deletion is shown in FIG. 2 (SEQ ID NO:53894).

Plant e01 had a 4 bp deletion in BnaC.FAD2.a and a 5 bp deletion in BnaC.FAD2.a (FIG. 3). The 4 bp deletion corresponded to nucleotides 252-255 of SEQ ID NO:3, and the 5 bp deletion corresponded to nucleotides 251-255 of SEQ ID NO:3. The region with the 5 bp and 4 bp deletions is shown in FIG. 3 (SEQ. ID NOS:53897 and 53894, respectively).

Plant e02 had a 5 bp deletion in BnaC.FAD2.a (FIG. 4), The 5 bp deletion corresponded to nucleotides 251-255 of SEQ ID NO:3; the region with the 5 bp deletion is shown in FIG. 4 (SEQ ID NO:53897).

Plant f02 had a 5 bp deletion in BnaC.FAD2a (FIG. 5). The 5 bp deletion corresponded to nucleotides 251-255 of SEQ ID NO:3; the region with the 5 bp deletion is shown in FIG. 5 (SEQ ID NO:53897).

In further studies, thirty-two (32) fertile *B. napus* T0 plants transformed with TALE nuclease pair BnFAD2_T03 were identified as containing mutations within FAD2 gene copies (TABLE 12). In total, 66 novel alleles containing deletions or insertions in the FAD2 genes BnaA.FAD2.a, BnaC.FAD2.a, and BnaC.FAD2.b were generated in the T0 population, including 26 alleles in the BnaA.FAD2.a gene with indels ranging from −25 bp to +96 bp, 27 alleles in the BnaC.FAD2.a gene with indels ranging from −69 bp to +101 bp, and 13 alleles in the BnaC.FAD2.b alleles with indels ranging from −16 bp to +44 bp. Sequences for the mutant BnaA.FAD2.a alleles are provided in TABLE 13A, sequences for the mutant BnaC.FAD2.a alleles are provided in TABLE 13B, and sequences for the mutant BnaC.FAD2.b alleles are provided in TABLE 13C.

T0 plant Bn432-a had mutations in the genes BnaA.FAD2.a, BnaC.FAD2.a, and BnaC.FAD2.b genes:

A 3 bp deletion (SEQ ID NO:53900) and a 6 bp deletion (SEQ ID NO:53901) in the BnaA.FAD2.a gene. The 3 bp deletion corresponded to nucleotides 98-100 of SEQ ID NO:1, and the 6 bp deletion corresponded to nucleotides 97-102 of SEQ ID NO:1.

A 3 bp deletion and a 1 bp insertion in one allele of the BnaC.FAD2.a gene (SEQ ID NO:53902) and a 7 bp deletion (SEQ ID NO:53903) in the other allele of the BnaC.FAD2.a gene. The 3 bp deletion corresponded to nucleotides 99-101 of SEQ ID NO:3, and the 1 bp insertion was at nucleotide 99. The 7 bp deletion corresponded to nucleotides 98-104 of SEQ ID NO:3.

A 13 bp deletion (SEQ ID NO:53904) in one allele of the BnaC.Fad2.b gene. The 13 bp deletion corresponded to nucleotides 92-104 of SEQ ID NO:2.

Sequences containing the deletions are shown in FIG. 6.

T0 plant Bn432-b had mutations in the BnaA.FAD2.a and BnaC.FAD2.a genes:

A 6 bp deletion and a 50 bp insertion (SEQ ID NO:53905) in both alleles of the BnaA.FAD2.a gene. The 6 bp deletion corresponded to nucleotides 96-101 of SEQ ID NO:1, with the 50 bp fragment inserted at position 96.

A 6 bp deletion and a 50 bp insertion (SEQ ID NO:53905) in one allele of the BnaC.FAD2.a gene and an 18 bp deletion and a 166 bp insertion (SEQ ID NO:53906) in the other allele of the BnaC.FAD2.a gene. The 6 bp deletion corresponded to nucleotides 96-101 of SEQ ID NO:3, with the 50 bp fragment inserted at position 96. The 18 bp deletion corresponded to nucleotides 101-118 of SEQ ID NO:3 with the 166 bp fragment inserted at position 101.

Sequences showing the deletions and insertions are shown in FIG. 6.

As illustrated in FIG. 7, T1 *Brassica* plants from T0 plant Bn432-a (Bn432-01, Bn432-02, and Bn432-03) and T1 *Brassica* plants from T0 plant Bn432-b (Bn432-05 and Bn432-07) containing mutations in FAD2 gene copies (TABLE 14) were crossed in order to combine knockout mutations and inactivate one, two, or all three FAD2 genes (BnaA.FAD2.a, BnaC.FAD2.a, and BnaC.FAD2.b). F2 mutants were generated and advanced to phenotypic analysis. Mutant F2 plants were classified in different groups for analysis, based on the mutation profile of the BnaA.FAD2.a, BnaC.FAD1.a, and BnaC.FAD2.b genes:

Group 1 (3-gene knockout: BnaA.FAD2.a, BnaC.FAD2.a, and BnaC.FAD2.b); 21 lines
Group 2a (2-gene knockout: BnaA.FAD2.a and BnaC.FAD2.a); 7 lines
Group 2b (2-gene knockout: BnaC.FAD2.a and BnaCFAD2.b); 4 lines
Group 3 (1-gene knockout: BnaC.FAD2.a); 5 lines
Group 4 (cv Westar wild type control); 2 lines Example 5—Phenotyping FAD2-Mutant *B. napus* Plants for Oil Composition F3 seeds derived from 37 F2 *B. napus* lines with mutations in one, two, or all three FAD2 genes, or seeds from wild type control cv Westar, were isolated and analyzed for fatty acid composition. Fatty acid composition was determined using FAME gas chromatography (Beuselinck et al., *Crop Sci.* 47:747-750, 2006). Results are presented in TABLES 15 and 16.

Samples with 3-gene knockout mutations (Group 1) demonstrated increased oleic acid (18:1), reduced linoleic acid (18:2), and reduced linolenic acid (18:3) content as compared to wild type *Brassica* cv Westar. In Group 1 mutants on average, oleic acid content was increased by 24%, from 67.3% to 83.5%, linoleic acid content was decreased by 85%, from 16.5% to 2.4%, and linolenic acid content was decreased by 47%, from 5.9% to 3.1%, as compared to wild type cv Westar. Samples in Group 1 with different knockout mutation profiles in the BnaC.FAD2.a gene (−18,+166/−18.+166; −3.+1/−3,+1; −7/−7; −18,+166/−3,+1; and −18,+166/−7) exhibited comparable oleic, linoleic, and linolenic acid composition profiles.

Samples with 2-gene knockout mutations in the BnaA.FAD2.a and BnaC.FAD2.a genes (Group 2a) had increased oleic acid (18:1), reduced linoleic acid (18:2), and reduced linolenic acid (18:3) content as compared to wild type *Brassica* cv Westar. In Group 2a mutants on average, oleic acid content was increased by 21.9%, from 67.3% to 82%, linoleic acid content was decreased by 81.5%, from 16.5% to 3%, and linolenic acid content was decreased by 35%, from 5.9% to 3.8%, as compared to wild type cv Westar.

Samples in Group 2a with different knockout mutation profiles in the BnaC.FAD2.a gene (−18,+166/−18,+166; −3,+1/−3,+1; and −18,+166/−7) demonstrated comparable oleic, linoleic, and linolenic acid composition profiles.

Samples with 2-gene knockout mutations in the BnaC.FAD2.a and BnaC.FAD2.b genes (Group 2b) exhibited increased oleic acid (18:1), reduced linoleic acid (18:2), and reduced linolenic acid (18:3) content as compared to wild type *Brassica* cv Westar. In Group 2b mutants on average, oleic acid content was increased by 23.4%, from 67.3% to 83%, linoleic acid content was decreased by 84.5%, from 16.5% to 3.2%, and linolenic acid content was decreased by 44.9%, from 5.9% to 3.2%, as compared to wild type cv Westar. Samples in Group 2b with different in-frame mutations in the BnaA.FAD2.a gene and different knockout mutation profiles in the BnaC.FAD2.a gene (−18,+166/−7 and −3,+1/−3,+1) had comparable oleic, linoleic, and linolenic acid composition profiles.

Samples with one-gene knockout of the BnaC.FAD2.a gene (Group 3) demonstrated increased oleic acid (18:1), reduced linoleic acid (18:2), and reduced linolenic acid (18:3) content as compared to wild type *Brassica* cv Westar. In Group 3 mutants on average, oleic acid content was increased by 20.9%, from 67.3% to 81.3%, linoleic acid content was decreased by 79.7%, from 16.5% to 3.3%, and linolenic acid content was decreased by 38.8%, from 5.9% to 3.6%, as compared to wild type cv Westar. Samples in Group 3 with different in-frame mutations in the BnaA.FAD2.a gene and different knockout mutation profiles in the BnaC.FAD2.a gene (−18,+166/−18,+166; −18,+166/−7; and −7/−7) had comparable oleic, linoleic, and linolenic acid composition profiles.

TABLE 12

| | T0 plants | | |
|---|---|---|---|
| T0 plant | BnaA.Fad2a | BnaC.Fad2a | BnaC.Fad2b |
| Bn432-a | −3/−6 | −3, +1/−7 | −13/wt |
| Bn432-b | −6, +50/−6, +50 | −6, +50/−18, +166 | wt/wt |
| Bn432-c | −36, +13/−36, +13 | −36, +13/wt | wt/wt |
| Bn432-d | −29, +4/wt | −29, +4/−29, +4 | −4, +1/−4, +1 |
| Bn432-e | −10/wt | −4, +106/−10 | −9/wt |
| Bn432-f | −3/−5, +1 | −18/−18 | −4/+44 |
| Bn432-g | −3/−3 | −11/−3 | −8/−8 |
| Bn432-h | wt/wt | −2, +55/−2, +55 | wt/wt |

TABLE 12-continued

| | T0 plants | | |
|---|---|---|---|
| T0 plant | BnaA.Fad2a | BnaC.Fad2a | BnaC.Fad2b |
| Bn468-a | −3, +1/−6 | +1/−3 | wt/wt |
| Bn468-b | −8/−16 | −3/−3 | wt/wt |
| Bn468-c | wt/wt | wt/wt | −7/wt |
| Bn468-d | wt/wt | wt/wt | −7/wt |
| Bn468-e | −7, +20/wt | wt/wt | wt/wt |
| Bn468-f | wt/wt | −2/wt | wt/wt |
| Bn468-g | −17, +14/−17, +14 | −5/−5 | wt/wt |
| Bn468-h | wt/wt | wt/wt | −4, +44/wt |
| Bn471-a | −4/−9 | −3, +90/−3, +90 | wt/wt |
| Bn471-b | −4, +1/−4, +1 | wt/wt | wt/wt |
| Bn476-a | −6/−6 | −8/−8 | +1/wt |
| Bn476-b | −2, +1/−3 | wt/wt | −2/wt |
| Bn476-c | wt/wt | wt/wt | −16/wt |
| Bn482-a | −3/−3 | −5/−18 | −4/wt |
| Bn482-b | −3/−74, +5 | −74, +5/−74, +5 | wt/wt |
| Bn482-c | −4/−4 | −3/−3 | −3/+29 |
| Bn482-d | −3/−3 | wt/wt | wt/wt |
| Bn482-e | −3/−3 | −3/−3 | wt/wt |
| Bn482-f | −4/wt | wt/wt | −3/wt |
| Bn482-g | wt/wt | −5/−5 | wt/wt |
| Bn482-h | −11/−11 | −6/−10 | wt/wt |
| Bn482-i | −3/−3 | −2/+77 | wt/wt |
| Bn482-j | −7/−3 + 99 | −7/−7 | −3/−3 |
| Bn482-k | −3, +1/+4 | −3/+95 | −4/−4 |
| No. of novel alleles | 26 | 27 | 13 |

TABLE 13A

Sequences of mutant T0 BnaA.Fad2a alleles

Bn432-a (−3):
(SEQ ID NO:53907)
CAGGATCCATGGGTGCAGGTGGAAGAATGCAAGTGTCTCCTCCCTCCAA
AAAGTCTGAAACCGACAACATCAAGCGCGTACCCTGCGAGACACCGCCC
TTCACTGGAGAACTCAAGAAAGCAATCCCACCGCACTGTTTCAAACGCT
CGATCCCTCGCTCTTTCTCCTACCTCATCTGGGACATCATCATAGCCTC
CTGCTTCTACTACGTCGCCACCACTTACTTCCCTCTCCTCCCTCACCCT
CTCTCCTACTTCGCCTGGCCTCTCTACTGGGCCTGCCAAGGGTGCGTCC
TAACCGGCGTCTGGGTCATAGCCCACGAGTGCGGCCACCACGCCTTCAG
CGACTAC

Bn432-a (−6):
(SEQ ID NO:53908)
CAGGATCCATGGGTGCAGGTGGAAGAATGCAAGTCTCTCCTCCCTCCAA
AAAGTCTGAAACCGACAACATCAAGCGCGTACCCTGCGAGACACCGCCC
TTCACTGAACTCAAGAAAGCAATCCCACCGCACTGTTTCAAACGCTCGA
TCCCTCGCTCTTTCTCCTACCTCATCTGGGACATCATCATAGCCTCCTG
CTTCTACTACGTCGCCACCACTTACTTCCCTCTCCTCCCTCACCCTCTC
TCCTACTTCGCCTGGCCTCTCTACTGGGCCTGCCAGGGCTGCGTCCTAA
CCGGCGTCTGGGTCATAGCCCACGAGTGCGGCCACCACGCCTTCAGCGA
CTAC

Bn432-b (−6,+50):
(SEQ ID NO:53909)
CAGGATCCATGGGTGCAGGTGGAAGAATGCAAGTGTCTCCTCCCTCCAA
AAAGTCTGAAACCGACAACATCAAGCGCGTACCCTGCGAGACACCGCCC
TTCACAGTTTCCAAAAGGTCGTTGATCAAAGCTCGCCGCGTTGTTTCAT
CAAGCCAGAACTCAAGAAAGCAATCCCACCGCACTGTTTCAAACGCTCG
ATCCCTCGCTCTTTCTCCTACCTCATCTGGGACCTCATCATAGCCTCCT
GCTTCTACTACGTCGCCACCACTTACTTCCCTCTCCTCCCTCACCCTCT
CTCCTACTTCGCCTGGCCTCTCTACTGGGCCTGCCAAGGGTGCGTCCTA
ACCGGCGTCTGGGTCATAGCCCACGAGTGCGGCCACCACGCCTTCAGCG
ACTAC

Bn432-c (−36,+13):
(SEQ ID NO:53910)
CAGGATCCATGGGTGCAGGTGGAAGAATGCAAGTGTCTCCTCCCTCCAA
AAAGTCTGAAACCGACAACATCAAACCGACAACAACAAGAACTCAAGAA
AGCAATCCCACCGCACTGTTTCAAACGCTCGATCCCTCGCTCTTTCTCC
TACCTCATCTGGGACATCATCATAGCCTCCTGCTTCTACTACGTCGCCA
CCACTTACTTCCCTCTCCTCCCTCACCCTCTCTCCTACTTCGCCTGGCC
TCTCTACTGGGCCTGCCAGGGCTGCTTCCTAACCGGCGTCTGGGTCATA
GCCCACGAGTTCGGCCACCACGCCTTCAGCGACTAC

Bn432-d (−29,+4):
(SEQ ID NO:53911)
CAGGATCCATGGGTGCAGGTGGAAGAATGCAAGTGTCTCCTCCCTCCAA
AAAGTCTGAAACCGACACCATCAAGCGCGTACCCTGCGAGACACCGCCC
TTCACTGTGAGAACTGTTTCAAACGCACGATCCCTCGCTCTTTCTCCTA
CCTCATCTGGGACATCATCATAGCCTCCTGCTTCTACTACGTCGCCACC
ACTTACTTCCCTCTCCTCCCTCACCCTCTCTCCTACTTCGCCTGGCCTC
TCTACTGGGCCTGCCAAGGCTGCGTCCTAACCGGCGTCTGGGTCATAGC
CCACGAGTGCGGCCACCACGCCTTCAGCGACTAC

Bn432-e (−10):
(SEQ ID NO:53912)
CAGGATCCATGGGTGCAGGTGGAAGAATGCAAGTGTCTCCTCCCTCCAA
AAAGTCTGAAACCGACAACATCAAGCGCGTACCCTGCGAGACACCGCCC
TTGAACTCAAGAAAGCAATCCCACCGCACTGTTTCAAACGCTCGATCCC
TCGCTCTTTCTCCTACCTCATCTGGGACATCATCATAGCCTCCTGCTTC
TACTACGTCGCCACCACTTACTTCCCTCTCCTCCCTCACCCTCTCTCCT
ACTTCGCCTGGCCTCTCTACTGGGCCTGCCAAGGGTGCGTCCTAACCGG
CGTCTGGGTCATAGCCCACGAGTGCGGCCACCACGCCTTCAGCGACTAC

Bn432-f (−3):
(SEQ ID NO:53913)
CAGGATCCATGGGTGCAGGTGGAAGAATGCAAGTGTCTCCTCCCTCCAA
GAAGTCTGAAACCGACACCATCAAGCGCGTACCCTGCGAGACACCGCCC
TTCACTGTAGAACTCAAGAAAGCAATCCCACCGCACTGTTTCAAACGCT
CGATCCCTCGCTCTTTCTCCTACCTCATCTTGGACATCATCATAGCCTC
CTGCTTCTACTACGTCGCCACCACTTACTTCCCTCTCCTCCCTCACCCT
CTCTCCTACTTCGCCTGGCCTCTCTACTGGGCCTGCCAGGGCTGCGTCC
TAACCGGCGTCTGGGTCATAGCCCACGAGTGCGGCCACCACGCCTTCAG
CGACTAC

Bn432-f (−5,+1):
(SEQ ID NO:53914)
CAGGATCCATGGGTGCAGGTGGAAGAATGCAAGTGTCTCCTCCCTCCAA
AAAGTCTGAAACCGACAACATCAAGCGCGTACCCTGCGAGACACCGCCC
TTCACTGTAAACTCAAGAAAGCAATCCCACCGCACTGTTTCAAACGCTC
GATCCCTCGCTCTTTCTCCTACCTCATCTGGGACATCATCATAGCCTCC
TGCTTCTACTACGTCGCCACCACTTACTTCCCTCTCCTCCCTCACCCTC

TABLE 13A-continued

Sequences of mutant T0 BnaA.Fad2a alleles

TCTCCTACTTCGCCTGGCCTCTCTACTGGGCCTGCCAAGGGTGCGTCCT
AACCGGCGTCTGGGTCATAGCCCACGAGTGCGGCCACCACGCCTTCAGC
GACTAC

Bn432-g (-3):
(SEQ ID NO:53915)
CAGGATCCATGGGTGCAGGTGGAAGAATGCAAGTGTCTCCTCCCTCCAA
AAAGTCTGAAACCGACAACATCAAGCGCGTACCCTGCGAGACACCGCCC
TTCACTGTAGAACTCAAGAAAGCAATCCCACCGCACTGTTTCAAACGCT
CGATCCCTCGCTCTTTCTCCTACCTCATCTGGGACATCATCATAGCCTC
CTGCTTCTACTACGTCGCCACCACTTACTTCCCTCTCCTCCCTCACCCT
CTCTCCTACTTCGCCTGGCCTCTCTACTGGGCCTGCCAGGGCTGCGTCC
TAACCGGCGTCTGGGTCATAGCCCACGAGTGCGGCCACCACGCCTTCAG
CGACTAC

Bn468-a (-3,+1):
(SEQ ID NO:53916)
CAGGATCCATGGGTGCAGGTGGAAGAATGCAAGTGTCTCCTCCCTCCAA
AAAGTCTGAAACCGACAACATCAAGCGCGTACCCTGCGAGACACCGCCC
TTCACTGTTAGAACTCAAGAAAGCAATCCCACCGCACTGTTTCAAACGC
TCGATCCCTCGCTCTTTCTCCTACCTCATCTGGGACATCATCATAGCCT
CCTGCTTCTACTACGTCGCCACCACTTACTTCCCTCTCCTCCCTCACCC
TCTCTCCTACTTCGCCTGGCCTCTCTACTGGGCCTGCCAGGGCTGCGTC
CTAACCGGCGTCTGGGTCATAGCCCACGAGTGCGGCCACCACGCCTTCA
GCGACTAC

Bn468-a (-6):
(SEQ ID NO:53917)
CAGGATCCATGGGTGCAGGTGGAAGAATGCAAGTGTCTCCTCCCTCCAA
AAAGTCTGAAACCGACAACATCAAGCGCGTACCCTGCGAGACACCGCCC
TTCACAGAACTCAAGAAAGCAATCCCACCGCACTGTTTCAAACGCTCGA
TCCCTCGCTCTTTCTCCTACCTCATCTGGGACATCATCATAGCCTCCTG
CTTCTACTACGTCGCCACCACTTACTTCCCTCTCCTCCCTCACCCTCTC
TCCTACTTCGCCTGGCCTCTCTACTGGGCCTGCCAGGGCTGCGTCCTAA
CCGGCGTCTGGGTCATAGCCCACGAGTGCGGCCACCACGCCTTCAGCGA
CTAC

Bn468-b (-8):
(SEQ ID NO:53918)
CAGGATCCATGGGTGCAGGTGGAAGAATGCAAGTGTCTCCTCCCTCCAA
AAAGCCTGAAACCGACAACATCAAGCGCGTACCCTGCGAGACACCGCCC
TTCACTGTCCAAGAAAGCAATCCCACCGCACTGTTTCAAACGCTCGATC
CCTGCTCTTTCTCCTACCTCATCTGGGACATCATCATAGCCTCCTGCT
TCTACTACGTCGCCACCACTTACTTCCCTCTCCTCCCTCACCCTCTCTC
CTACTTCGCCTGGCCTCTCTACTGGGCCTGCCAGGGCTGCGTCCTAACC
GGCGTCTGGGTCATCGCCCACGAGTGCGGCCACCACGCCTTCAGCGACT
AC

Bn468-b (-16):
(SEQ ID NO:53919)
CAGGATCCATGGGTGCAGGTGGAAGAATGCAAGTGTCTCCTCCCTCCAA
AAAGTCTGAAACCGACAACATCAAGCGCGTACCCTGCGAGACACCGCCC
TTCACTGAGCAATCCCACCGCACTGTTTCAAACGCTCGATCCCTCGCTC
TTTCTCCTACCTCATCTGGGACATCATCATAGCCTCCTGCTTCTACTAC
GTCGCCACCACTTACTTCCCTCTCCTCCCTCACCCTCTCTCCTACTTCG
CCTGGCCTCTCTACTGGGCCTGCCAGGGCTGCGTCCTAACCGGCGTCTG
GGTCATAGCCCACGAGTGCGGCCACCACGCCTTCAGCGACTAC

Bn468-e (-7,+20):
(SEQ ID NO:53920)
CAGGATCCATGGGTGCAGGTGGAAGAATGCAAGTGTCTCCTCCCTCCAA
AAAGTCTGAAACCGACAACATCAAGCGCGTACCCTGCGAGACACCGCCC
TTCAATCGCCAGCAATAATGGTGGAGAACTCAAGGAAGCAATCCCACCG
CACTGTTTCAAACGCTCGATCCCTCGCTCTTTCTCCTACCTCATCTGGG
ACATCATCATAGCCTCCTGCTTCTACTACGTCGCCACCACTTACTTCCC
TCTCCTCCCTCACCCTCTCTCCTACTTCGCCTGGCCTCTCTACTGGGCC
TGCCAGGGCTGCGTCCTAACCGGCGTCTGGGTCATAGCCCACGAGTGCG
GCCACCACGCCTTCAGCGACTAC

Bn468-g (-17,+14):
(SEQ ID NO:53921)
CAGGATCCATGGGTGCAGGTGGAAGAATGCAAGTGTCTCCTCCCTCCAA
AAAGTCTGAAACCGACAACATCAAGCGCGTACCCTGCGAGACAACTCTT
TTTCTCGGAGAACTCAAGAAAGCAATCCCACCGCACTGTTTCAAACGCT
CGATCCCTCGCTCTTTCTCCTACCTCATCTGGGACATCATCATAGCCTC

TABLE 13A-continued

Sequences of mutant T0 BnaA.Fad2a alleles

CTGCTTCTACTACGTCGCCACCACTTACTTCCCTCTCCTCCCTCACCCT
CTCTCCTACTTCGCCTGGCCTCTCTACTGGGCCTGCCAGGGCTGCGTCC
TAACCGGCGTCTGGGTCATAGCCCACGAGTGCGGCCACCACGCCTTCAG
CGACTAC

Bn471-a (-4):
(SEQ ID NO:53922)
CAGGATCCATGGGTGCAGGTGGAAGAATGCAAGTGTCTCCTCCCTCCAA
AAAGTCTGAAACCGACAACATCAAGCGCGTACCCTGCGAGACACCGCCC
TTCACTGAGAACTCAAGAAAGCAATCCCACCGCACTGTTTCAAACGCTC
GATCCCTCGCTCTTTCTCCTACCTCATCTGGGACATCATCATAGCCTCC
TGCTTCTACTACGTCGCCACCACTTACTTCCCTCTCCTCCCTCACCCTC
TCTCCTACTTCGCCTGGCCTCTCTACTGGGCCTGCCAAGGGTGCGTCCT
AACCGGCGTCTGGGTCATAGCCCACGAGTGCGGCCACCACGCCTTCAGC
GACTAC

Bn471-a (-9):
(SEQ ID NO:53923)
CAGGATCCATGGGTGCAGGTGGAAGAATGCAAGTGTCTCCTCCCTCCAA
AAAGTCTGAAACCGACAACATCAAGCGCGTACCCTGCGAGACACCGCCC
TTAGAACTCAAGAAAGCAATCCCACCGCACTGTTTCAAACGCTCGATCC
CTCGCTCTTTCTCCTACCTCATCTGGGACATCATCATAGCCTCCTGCTT
CTACTACGTCGCCACCACTTACTTCCCTCTCCTCCCTCACCCTCTCTCC
TACTTCGCCTGGCCTCTCTACTGGGCCTGCCAGGGCTGCGTCCTAACCG
GCGTCTGGGTCATAGCCCACGAGTGCGGCCACCACGCCTTCAGCGACTA
C

Bn471-b (-4,+1):
(SEQ ID NO:53924)
CAGGATCCATGGGTGCAGGTGGAAGAATGCAAGTGTCTCCTCCCTCCAA
AAAGTCTGAAACCGACAACATCAAGCGCGTACCCTGCGAGACACCGCCC
TTCGAAGAACTCAAGAAAGCAATCCCACCGCACTGTTTCAAACGCT
CGATCCCTCGCTCTTTCTCCTACCTCATCTGGGACATCATCATAGCCTC
CTGCTTCTACTACGTCGCCACCACTTACTTCCCTCTCCTCCCTCACCCT
CTCTCCTACTTCGCCTGGCCTCTCTAGTGGGCCTGCCAGGGCTGCGTCC
TAACCGGCGTCTGGGTCATAGCCCACGAGTGCGCCCACCCCGCCTTCGG
CGACTCC

Bn476-a (-6):
(SEQ ID NO:53908)
CAGGATCCATGGGTGCAGGTGGAAGAATGCAAGTGTCTCCTCCCTCCAA
AAAGTCTGAAACCGACAACATCAAGCGCGTACCCTGCGAGACACCGCCC
TTCACTGAACTCAAGAAAGCAATCCCACCGCACTGTTTCAAACGCTCGA
TCCCTCGCTCTTTCTCCTACCGCATCTGGGACATCATCATAGCCTCCTG
CTTCTACTACGTCGCCACCACTTACTTCCCTCTCCTCCCTCACCCTCTC
TCCTACTTCGCCTGGCCTCTCTACTGGGACTGCCAGGGCTGCGTCCTAA
CCGGCGTCTGGGTCATAGCCCACGAGTGCGGCCACCACGCCTTCAGCGA
CTAC

Bn476-b (-2,+1):
(SEQ ID NO:53925)
CAGGATCCATGGGTGCAGGTGGAAGAATGCAAGTGTCTCCTCCCTCCAA
AAAGTCTGAAACCGACAACATCAAGCGCGTACCCTGCGAGACACCGCCC
TTCACTGTCTAGAACTCAAGAAAGCAATCCCACCGCACTGTTTCAAACG
CTCGATCCCTCGCTCTTTCTCCTACCTCATCTGGGACATCATCATAGCC
TCCTGCTTCTACTACGTCGCCACCACTTACTTCCCTCTCCTCCCTCACC
CTCTCTCCTACTTCGCCTGGCCTCTCTACTGGGCCTGCCAGGGCTGCGT
CCTAACCGGCGTCTGGGTCATAGCCCACGAGTGCGGCCACCACGCCTTC
AGCGACTAC

Bn476-b (-3):
(SEQ ID NO:53913)
CAGGATCCATGGGTGCAGGTGGAAGAATGCAAGTGTCTCCTCCCTCCAA
AAAGTCTGAAACCGACAACATCAAGCGCGTACCCTGCGAGACACCGCCC
TTCACTGTAGAACTCAAGAAAGCAATCCCACCGCACTGTTTCAAACGCT
CGATCCCTCGCTCTTTCTCCTACCTCATCTGGGACATCATCATAGCCTC
CTGCTTCTACTACGTCGCCACCACTTACTTCCCTCTCCTCCCTCACCCT
CTCTCCTACTTCGCCTGGCCTCTCTACTGGGCCTGCCAAGGGTGCGTCC
TAACCGGCGTCTGGGTCATAGCCCACGAGTGCGGCCACCACGCCTTCAG
CGACTAC

Bn482-a (-3):
(SEQ ID NO:53913)
CAGGATCCATGGGTGCAGGTGGAAGAATGCAAGTGTCTCCTCCCTCCAA
AAAGTCTGAAACCGACAACATCAAGCGCGTACCCTGCGAGACACCGCCC
TTCACTGTAGAACTCAAGAAAGCAATCCCACCGCACTGTTTCAAACGCT
CGATCCCTCGCTCTTTCTCCTACCTCATCTGGGACATCATCATAGCCTC

TABLE 13A-continued

Sequences of mutant T0 BnaA.Fad2a alleles

CTGCTTCTACTACGTCGCCACCACTTACTTCCCTCTCCTCCCTCACCCT
CTCTCCTACTTCGCCTGGCCTCTCTACTGGGCCTGCCAAGGGTGCGTCC
TAACCGGCGTCTGGGTCATAGCCCACGAGTGCGGCCACCACGCCTTCAG
CGACTAC

Bn482-b (-3):
(SEQ ID NO:53926)
CAGGATCCATGGGTGCAGGTGGAAGAATGCAAGTGTCTCCTCCCTCCAA
AAAGTCTGAAACCGACAACATCAAGCGCGTACCCTGCGAGACACCGCCC
TTCACTGTAGAACTCAAGAAAGCAATCCCACCGCACTGTTTCAAACGCT
CGATCCCTCGCTCTTTCTCCTACCTCATCTGGGACATCATCATAGCCTC
CTGCTTCTACTACGTCGCCACCACTTACTTCCCTCTCCTCCCTCACCCT
CTCTCCTACTTCGCCTGGCCTCTCTACTGGGCCTGCCAGGGCTGCGTCC
TAACCGGCGTCTGGGTCATAGCCCACGAGTGCGGCCACCACGCCTTCAG
CGACTAC

Bn482-b (-74,+5):
(SEQ ID NO:53927)
CAGGATCCATGGGTGCAGGTGGAAGAATGCAAGTGTCTCCTCCCATCAA
GAAAGCAATCCCACCGCACTGTTTCAAACGCTCGATCCCTCGCTCTTTC
TCCTACCTCATCTGGGACATCATCATAGCCTCCTGCTTCTACTACGTCG
CCACCACTTACTTCCCTCTCCTCCCTCACCCTCTCTCCTACTTCGCCTG
GCCTCTCTACTGGGCCTGCCAGGGCTGCGTCCTAACCGGCGTCTGGGTC
ATAGCCCACGAGTGCGGCCACCACGCCTTCAGCGACTAC

Bn482-c (-4):
(SEQ ID NO:53922)
CAGGATCCATGGGTGCAGGTGGAAGAATGCAAGTGTCTCCTCCCTCCAA
AAAGTCTGAAACCGACAACATCAAGCGCGTACCCTGCGAGACACCGCCC
TTCACTGAGAACTCAAGAAAGCAATCCCACCGCACTGTTTCAAACGCTC
GATCCCTCGCTCTTTCTCCTACCTCATCTGGGACATCATCATAGCCTCC
TGCTTCTACTACGTCGCCACCACTTACTTCCCTCTCCTCCCTCACCCTC
TCTCCTACTTCGCCTGGCCTCTCTACTGGGCCTGCCAGGGCTGCGTCCT
AACCGGCGTCTGGGTCATAGCCCACGAGTGCGGCCACCACGCCTTCAGC
GACTAC

Bn482-d (-3):
(SEQ ID NO:53926)
CAGGATCCATGGGTGCAGGTGGAAGAATGCAAGTGTCTCCTCCCTCCAA
AAAGTCTGAAACCGACAACATCAAGCGCGTACCCTGCGAGACACCGCCC
TTCACTGTAGAACTCAAGAAAGCAATCCCACCGCACTGTTTCAAACGCT
CGATCCCTCGCTCTTTCTCCTACCTCATCTGGGACATCATCATAGCCTC
CTGCTTCTACTACGTCGCCACCACTTACTTCCCTCTCCTCCCTCACCCT
CTCTCCTACTTCGCCTGGCCTCTCTACTGGGCCTGCCAAGGGTGCGTCC
TAACCGGCGTCTGGGTCATAGCCCACGAGTGCGGCCACCACGCCTTCAG
CGACTAC

Bn482-e (-3):
(SEQ ID NO:53913)
CAGGATCCATGGGTGCAGGTGGAAGAATGCAAGTGTCTCCTCCCTCCAA
GAAGTCTGAAACCGACACCATCAAGCGCGTACCCTGCGAGACACCGCCC
TTCACTGTAGAACTCAAGAAAGCAATCCCACCGCACTGTTTCAAACGCT
CGATCCCTCGCTCTTTCTCCTACCTCATCTGGGACATCATCATAGCCTC
CTGCTTCTACTACGTCGCCACCACTTACTTCCCTCTCCTCCCTCACCCT
CTCTCCTACTTCGCCTGGCCTCTCTACTGGGCCTGCCAGGGCTGCGTCC
TAACCGGCGTCTGGGTCATAGCCCACGAGTGCGGCCACCACGCCTTCAG
CGACTAC

Bn482-f (-4):
(SEQ ID NO:53922)
CAGGATCCATGGGTGCAGGTGGAAGAATGCAAGTGTCTCCTCCCTCCAA
AAAGTCTGAAACCGACAACATCAAGCGCGTACCCTGCGAGACACCGCCC
TTCACTGAGAACTCAAGAAAGCAATCCCACCGCACTGTTTCAAACGCTC
GATCCCTCGCTCTTTCTCCTACCTCATCTGGGACATCATCATAGCCTCC
TGCTTCTACTACGTCGCCACCACTTACTTCCCTCTCCTCCCTCACCCTC
TCTCCTACTTCGCCTGGCCTCTCTACTGGGCCTGCCAGGGCTGCGTCCT
AACCGGCGTCTGGGTCATAGCCCACGAGTGCGGCCACCACGCCTTCAGC
GACTAC

Bn482-h (-11):
(SEQ ID NO:53928)
CAGGATCCATGGGTGCAGGTGGAAGAATGCAAGTGTCTCCTCCCTCCAA
AAAGTCTGAAACCGACAACATCAAGCGCGTACCCTGCGAGACACCGCCC
TTCACTCAAGAAAGCAATCCCACCGCACTGTTTCAAACGCTCGATCCCT
CGCTCTTTCTCCTACCTCATCTGGGACATCATCATAGCCTCCTGCTTCT
ACTACGTCGCCACCACTTACTTCCCTCTCCTCCCTCACCCACTCTCCTA
CTTCGCCTGGCCTCTCTACTGGGCCTGCCAGGGCTGCGTCCTAACCGGC
GTCTGGGTCATAGCCCACGAGTGCGGCCACCACGCCTTCAGCGACTAA

Bn482-i (-3):
(SEQ ID NO:53913)
CAGGATCCATGGGTGCAGGTGGAAGAATGCAAGTGTCTCCTCCCTCCAA
AAAGTCTGAAACCGACAACATCAAGCGCGTACCCTGCGAGACACCGCCC
TTCACTGTAGAACTCAAGAAAGCAATCCCACCGCACTGTTTCAAACGCT
CGATCCCTCGCTCTTTCTCCTACCTCATCTGGGACATCATCATAGCCTC
CTGCTTCTACTACGTCGCCACCACTTACTTCCCTCTCCTCCCTCACCCT
CTCTCCTACTTCGCCTGGCCTCTCTACTGGGCCTGCCAGGGCTGCGTCC
TAACCGGCGTCTGGGTCATAGCCCACGAGTGCGGCCACCACGCCTTCAG
CGACTAC

Bn482-j (-3,+99):
(SEQ ID NO:53929)
CAGGATCCATGGGTGCAGGTGGAAGAATGCAAGTGTCTCCTCCCTCCAA
AAAGTCTGAAACCGACAACATCAAGCGCGTACCCTGCGAGACACCGCCC
TTCACTGTATGGCTTGACCCCGGAGCAGGTGGTGGCCATCGCCAGCAAT
CTTGGCGGCAAGCAGGCGCTGGAGACAATGCAGGCGCTGTTGCCGGTGC
TGTGCCAGGAGAACTCAAGAAAGCAATCCCACCGCACTGTTTCCAACGC
TCGATCCCTCGCTCTTTCTCCTACCTCATCTGGGACATCATCATAGCCT
CCTGCTTCTACTACGTCGCCACCACTTACTTCCCTCTCCTCCCTCACCC
TCTCTCCTACTTCGCCTGGCCTCTCTACTGGGCTGCCAAGGGTGCGTC
CTAACCGGCGTCTGGGTCATAGCCCACGAGTGCGGCCACCACGCCTTCA
GCGACTAC

Bn482-j (-7):
(SEQ ID NO:53930)
CAGGATCCATGGGTGCAGGTGGAAGAATGCAAGTGTCTCCTCCCTCCAA
AAAGTCTGAAACCGACAACATCAAGCGCGTACCCTGCGAGACACCGCCC
TTCACTAACTCAAGAAAGCAATCCCACCGCACTGTTTCAAACGCTCGAT
CCCTCGCTCTTTCTCCTACCTCATCTGGGACATCATCATAGCCTCCTGC
TTCTACTACGTCGCCACCACTTACTTCCCTCTCCTCCCTCACCCTCTCT
CCTACTTCGCCTGGCCTCTCTACTGGGCCTGCCAGGGCTGCGTCCTAAC
GGGCCTCTGGGTCATAGCCCACGAGTGCGGCCACCACGCCTTCAGCGAC
TAC

Bn482-k (+4):
(SEQ ID NO:53931)
CAGGATCCATGGGTGCAGGTGGAAGAATGCAAGTGTCTCCTCCCTCCAA
AAAGTCTGAAACCGACAACATCAAGCGCGTACCCTGCGAGACACCGCCC
TTCACTGTCGGTCGGAGAACTCAAGAAAGCAATCCCACCGCACTGTTTC
AAACGCTCGATCCCTCGCTCTTTCTCCTACCTCATCTGGGACATCATCA
TAGCCTCCTGCTTCTACTACGTCGCCACCACTTACTTCCCTCTCCTCCC
TCACCCTCTCTCCTACTTCGCCTGGCCTCTCTACTGGGCCTGCCAGGGC
TGCGTCCTAACCGGCGTCTGGGTCATAGCCCACGAGTGCGGCCACCACG
CCTTCAGCGACTAC

Bn482-k (-3,+1):
(SEQ ID NO:53932)
CAGGATCCATGGGTGCAGGTGGAAGAATGCAAGTGTCTCCTCCCTCCAA
AAAGTCTGAAACCGACAACATCAAGCGCGTACCCCGCGAGACACCGCCC
TTCACTGTGAGAACTCAAGAAAGCAATCCCACCGCACTGTTTCAAACGC
TCGATCCCTCGCTCTTTCCTACCTCATCTGGGACATCATCATAGCCT
CCTGCTTCTACTACGTCGCCACCACTTACTTCCCTCTCCTCCCTCACCC
TCTCTCCTACTTCGCCTGGCCTCTCTACTGGGCCTGCCAGGGCTGCGTC
CTAACCGGCGTCTGGGTCATAGCCCACGAGTGCGGCCACCACGCCTTCA
GCGACTAC

TABLE 13B

Sequences of mutant T0 BnaC.Fad2a alleles

Bn432-a (-3,+1):
(SEQ ID NO:53933)
CAGGATCCATGGGTGCAGGTGGAAGAATGCAAGTGTCTCCTCCCTCCAA
GAAGTCTGAAACCGACACCATCAAGCGCGTACCCTGCGAGACACCGCCC
TTCACTGTTAGAACTCAAGAAAGCAATCCCACCGCACTGTTTCAAACGC
TCGATCCCTCGCTCTTTCTCCTACCTCATCTGGGACATCATCATAGCCT
CCTGCTTCTACTACGTCGCCACCACTTACTTCCCTCTCCTCCCTCACCC
TCTCTCCTACTTCGCCTGGCCTCTCTACTGGGCCTGCCAAGGGTGCGTC
CTAACCGGCGTCTGGGTCATAGCCCACGAGTGCGGCCACCACGCCTTCA
GCGACTAC

TABLE 13B-continued

Sequences of mutant T0 BnaC.Fad2a alleles

Bn432-a (-7):
(SEQ ID NO:53934)
CAGGATCCATGGGTGCAGGTGGAAGAATGCAAGTGTCTCCTCCCTCCAA
GAAGTCTGAAACCGACACCATCAAGCGCGTACCCTGCGAGACACCGCCC
TTCACTGACTCAAGAAAGCAATCCCACCGCACTGTTTCAAACGCTCGAT
CCCTCGCTCTTTCTCCTACCTCATCTGGGACATCATCATAGCCTCCTGC
TTCTACTACGTCGCCACCACTTACTTCCCTCTCCTCCCTCACCCTCTCT
CCTACTTCGCCTGGCCTCTCTACTGGGCCTGCCAAGGGTGCGTCCTAAC
CGGCGTCTGGGTCATAGCCCACGAGTGCGGCCACCACGCCTTCAGCGAC
TAC

Bn432-b (-6,+50):
(SEQ ID NO:53935)
CAGGATCCATGGGTGCAGGTGGAAGAATGCAAGTGTCTCCTCCCTCCAA
GAAGTCTGAAACCGACACCATCAAGCGCGTACCCTGCGAGACACCGCCC
TTCACAGTTTCCAAAGGTCGTTGATCAAAGCTCGCCGCGTTGTTTCAT
CAAGCCAGAACTCAAGAAAGCAATCCCACCGCACTGTTTCAAACGCTCG
ATCCCTCGCTCTTTCTCCTACCTCATCTGGGACATCATCATAGCCTCCT
GCTTCTACTACGTCGCCACCACTTACTTCCCTCTCCTCCCTCACCCTCT
CTCCTACTTCGCCTGGCCTCTCTACTGGGCCTGCCAAGGGTGCGTCCTA
ACCGGCGTCTGGGTCATAGCCCACGAGTGCGGCCACCACGCCTTCAGCG
ACTAC

Bn432-b (-18,+166):
(SEQ ID NO:53936)
CAGGATCCATGGGTGCAGGTGGAAGAATGCAAGTGTCTCCTCCCTCCAA
GAAGTCTGAAACCGACACCATCAAGCGCGTACCCTGCGAGACACCGCCC
TTCACTGTCGCTGGAGACGGTCCAGCGGCTGTTGCCGGTGCTGTGCCAG
GCCCACGGCTTGACCCCGGAGCAGGTGGTGGCCATCGCCTTTTTGCGTT
TCTACAAACTCTTCCTGGCTAGCGGTACGCGTATTAATTGCGTTGCGCT
CACTGCCCGCTTTCCAGTCGGGAAACCTGTCGTGCCACCGCACTGTTTC
AAACGCTCGATCCCTCGCTCTTTCTCCTACCTCATCTGGGACATCATCA
TAGCCTCCTGCTTCTACTACGTCGCCACCACGCCTTCAGCGACTAC

Bn432-c (-36,+13):
(SEQ ID NO:53937)
CAGGATCCATGGGTGCAGGTGGAAGAATGCAAGTGTCTCCTCCCTCCAA
GAAGTCTGAAACCGACACCATCAAACCGACAACATCAAGAACTCAAGAA
AGCAATCCCACCGCACTGTTTCAAACGCTCGATCCCTCGCTCTTTCTCC
TACCTCATCTGGGACATCATCATAGCCTCCTGCTTCTACTACGTCGCCA
CCACTTACTTCCCTCTCCTCCCTCACCCTCTCCCTTACCTCGCCTGGCC
CCTCTCCTGGGCCTGCCAAGGGTGCGTCCTAACGGGCCTCTGGGTCATC
GCCCACGAATGCGGCCACCACGCCTTCAGCGACTAC

Bn432-d (-29,+4):
(SEQ ID NO:53938)
CAGGATCCATGGGTGCAGGTGGAAGAATGCAAGTGTCTCCTCCCTCCAA
GAAGTCTGAAACCGACACCATCAAGCGCGTACCCTGCGAGACACCGCCC
TTCACTGTGAGAACTGTTTCAAACGCTCGATCCCTCGCTCTTTCTCCTA
CCTCATCTGGGACATCATCATAGCCTCCTGCTTCTACTACGTCGCCACC
ACTTACTTCCCTCTCCTCCCTCACCCTCTCCTCCTACTTCGCCTGGCCTC
TCTACTGGGCCTGCCAAGGGTGCGTCCTAACCGGCGTCTGGGTCATAGC
CCACGAGTGCGGCCACCACGCCTTCAGCGACTAC

Bn432-e (-4,+106):
(SEQ ID NO:53939)
CAGGATCCATGGGTGCAGGTGGAAGAATGCAAGTGTCTCCTCCCTCCAA
GAAGTCTGAAACCGACACCATCAAGCGCGTACCCTGCGAGACACCGCCC
TTCACTGCCAGGCCCACGGCTTGACCCCTCAGCAGGTGGTGGCCATCGC
CAGCAATGGCGGCGGCAGGCAGGCGCTGGAGACGGTCCAGCGGCTGTTG
CCGGTGCTGTGCGGGAACTCAAGAAAGCAATCCCACCGCACTGTTTCA
AACGCTCGATCCCTCGCTCTTTCTCCTACCTCATCTGGGACATCATCAT
AGCCTCCTGCTTCTACTACGTCGCCACCACTTACTTCCCTCTCCTCCCT
CACCCTCTCCTACTTCGCCTGGCCTCTCTACTGGGCCTGCCAAGGGT
GCGTCCTAACCGGCGTCTGGGTCATAGCCCACGAGTGCGGCCACCACGC
CTTCAGCGACTAC

Bn432-e (-10):
(SEQ ID NO:53940)
CAGGATCCATGGGTGCAGGTGGAAGAATGCAAGTGTCTCCTCCCTCCAA
GAAGTCTGAAACCGACAACATCAAGCGCGTACCCTGCGAGACACCGCCC
TTGAACTCAAGAAAGCAATCCCACCGCACTGTTTCAAACGCTCGATCCC
TCGCTCTTTCTCCTACCTCATCTGGGACATCATCATAGCCTCCTGCTTC
TACTACGTCGCCACCACTCTTACTTCCCTCTCCTCCCTCACCCTCTCCTT
ACTTCGCCTGGCCTCTCTACTGGGCCTGCCAAGGGTGCGTCCTAACCGG
CGTCTGGGTCATAGCCCACGAGTGCGGCCACCACGCCTTCAGCGACTAC

Bn432-f (-18):
(SEQ ID NO:53941)
CAGGATCCATGGGTGCAGGTGGAAGAATGCAAGTGTCTCCTCCCTCCAA
GAAGTCTGAAACCGACACCATCAAGCGCGTACCCTGCGAGACACCGCCC
AAGAAAGCAATCCCACCGCACTGTTTCAAACGCTCGATCCCTCGCTCTT
TCTCCTACCTCATCTGGGACATCATCATAGCCTCCTGCTTCTACTACGT
CGCCACCACTTACTTCCCTCTCCTCCCTCACCCTCTCTCCTACTTCGCC
TGGCCTCTCTACTGGGCCTGCCAAGGGTGCGTCCTAACCGGCGTCTGGG
TCATAGCCCACGAGTGCGGCCACCACGCCTTCAGCGACTAC

Bn432-g (-3):
(SEQ ID NO:53942)
CAGGATCCATGGGTGCAGGTGGAAGAATGCAAGTGTCTCCTCCCTCCAA
GAAGTCTGAAACCGACACCATCAAGCGCGTACCCTGCGAGACACCGCCC
TTCACTGGAGAACTCAAGAAAGCAATCCCACCGCACTGTTTCAAACGCT
CGATCCCTCGCTCTTTCTCCTACCTCATCTGGGACATCATCATAGCCTC
CTGCTTCTACTACGTCGCCACCACTTACTTCCCTCTCCTCCCTCACCCT
CTCCTACTTCGCCTGGCCTCTCTACTGGGCCTGCCAAGGGTGCGTCC
TAACCGGCGTCTGGGTCATAGCCCACGAGTGCGGCCACCACGCCTTCAG
CGACTAC

Bn432-g (-11):
(SEQ ID NO:53943)
CAGGATCCATGGGTGCAGGTGGAAGAATGCAAGTGTCTCCTCCCTCCAA
GAAGTCTGAAACCGACACCATCAAGCGCGTACCCTGCGAGACACCGCCC
TTCACTCAAGAAAGCAATCCCACCGCACTGTTTCAAACGCTCGATCCCT
CGCTCTTTCTCCTACCTCATCTGGGACATCATCATAGCCTCCTGCTTCT
ACTACGTCGCCACCACTTACTTCCCTCTCCTCCCTCACCCTCTCTCCTA
CTTCGCCTGGCCTCTCTACTGGGCCTGCCAAGGGTGCGTCCTAACCGGC
GTCTGGGTCATAGCCCACGAGTGCGGCCACCACGCCTTCAGCGACTAC

Bn432-h (-2,+55):
(SEQ ID NO:53944)
CAGGATCCATGGGTGCAGGTGGAAGAATGCAAGTGTCTCCTCCCTCCAA
GAAGTCTGAAACCGACACCATCAAGCGCGTACCCTGCGAGACACCGCCC
TTCACTGTCCGGCAACAGCCGCTGGACCGTCTCCAGCGCCTGCTTGCCG
CCATCGTGGCTGGCGAGAACTCAAGAAAGCAATCCCACCGCACTGTTTC
AAACGCTCGATCCCTCGCTCTTTCTCCTACCTCATCTGGGACATCATCA
TAGCCTCCTGCTTCTACTACGTCGCCACCACTTACTTCCCTCTCCTCCT
CACCCTCTCTCCTACTTCGCCTGGCCTCTCTACTGGGCCTGCCAAGGG
TGCGTCCTAACCGGCGTCTGGGTCATAGCCCACGAGTGCGGCCACCACG
CCTTCAGCGACTAC

Bn468-a (+1):
(SEQ ID NO:53945)
CAGGATCCATGGGTGCAGGTGGAAGAATGCAAGTGTCTCCTCCCTCCAA
GAAGTCTGAAACCGACACCATCAAGCGCGTACCCTGCGAGACACCGCCC
TTCACTGCGGGAGAACTCAAGAAAGCAATCCCACCGCACTGTTTCAAAC
GCTCGATCCCTCGCTCTTTCTCCTACCTCATCTGGGACATCATCATAG
CCTCCTGCTTCTACTACGTCGCCACCACTTACTTCCCTCTCCTCCCTCA
CCCTCTCTCCTACTTCGCCTGGCCTCTCTACTGGGCCTGCCAAGGGTGC
GTCCTAACCGGCGTCTGGGTCATAGCCCACGAGTGCGGCCACCACGCCT
TCAGCGACTAC

Bn468-a (-3):
(SEQ ID NO:53946)
CAGGATCCATGGGTGCAGGTGGAAGAATGCAAGTGTCTCCTCCCTCCAA
GAAGTCTGAAACCGACACCATCAAGCGCGTACCCTGCGAGACACCGCCC
TTCACTGTAGAACTCAAGAAAGCAATCCCACCGCACTGTTTCAAACGCT
CGATCCCTCGCTCTTTCTCCTACCTCATCTGGGACATCATCATAGCCTC
CTGCTTCTACTACGTCGCCACCACTTACTTCCCTCTCCTCCCTCACCCT
CTCCTACTTCGCCTGGCCTCTCTACTGGGCCTGCCAAGGGTGCGTCC
TAACCGGCGTCTGGGTCATAGCCCACGAGTGCGGCCACCACGCCTTCAG
CGACTAC

Bn468-b (-3):
(SEQ ID NO:53946)
CAGGATCCATGGGTGCAGGTGGAAGAATGCAAGTGTCTCCTCCCTCCAA
GAAGTCTGAAACCGACACCGACACCATCAAGCGCGTACCCTGCGAGACACCGCCC
TTCACTGTAGAACTCAAGAAAGCAATCCCACCGCACTGTTTCAAACGCT
CGATCCCTCGCTCTTTCTCCTACCTCATCTGGGACATCATCATAGCCTC
CTGCTTCTACTACGTCGCCACCACTTACTTCCCTCTCCTCCCTCACCCT
CTCCTACTTCGCCTGGCCTCTCTACTGGGCCTGCCAAGGGTGCGTCC
TAACCGGCGTCTGGGTCATAGCCCACGAGTGCGGCCACCACGCCTTCAG
CGACTAC

TABLE 13B-continued

Sequences of mutant T0 BnaC.Fad2a alleles

Bn468-f (-2):
(SEQ ID NO:53947)
CAGGATCCATGGGTGCAGGTGGAAGAATGCAAGTGTCTCCTCCCTCCAA
GAAGTCTGAAACCGACACCATCAAGCGCGTACCCTGCGAGACACCGCCC
TTCACTGTCAGAACTCAAGAAAGCAATCCCACCGCACTGTTTCAAACGC
TCGATCCCTCGCTCTTTCTCCTACCTCATCTGGGACATCATCATAGCCT
CCTGCTTCTACTACGTCGCCACCACTTACTTCCCTCTCCTCCCTCACCC
TCTCTCCTACTTCGCCTGGCCTCTCTACTGGGCCTGCCAAGGGTGCGTC
CTAACCGGCGTCTGGGTCATAGCCCACGAGTGCGGCCACCACGCCTTCA
GCGACTAC

Bn468-g (-5):
(SEQ ID NO:53948)
CAGGATCCATGGGTGCAGGTGGAAGAATGCAAGTGTCTCCTCCCTCCAA
GAAGTCTGAAACCGACACCATCAAGCGCGTACCCTGCGAGACACCGCCC
TTCACTAGAACTCAAGAAAGCAATCCCACCGCACTGTTTCAAACGCTCG
ATCCCTCGCTCTTTCTCCTACCTCATCTGGGACATCATCATAGCCTCCT
GCTTCTACTACGTCGCCACCACTTACTTCCCTCTCCTCCCTCACCCTCT
CTCCTACTTCGCCTGGCCTCTCTACTGGGCCTGCCAAGGGTGCGTCCTA
ACCGGCGTCTGGGTCATAGCCCACGAGTGCGGCCACCACGCCTTCAGCG
ACTAC

Bn471-a (-3,+90):
(SEQ ID NO:53949)
CAGGATCCATGGGTGCAGGTGGAAGAATGCAAGTCTCTCCTCCCTCCAA
GAAGTCTGAAACCGACACCATCAAGCGCGTACCCTGCGAGACACCGCCC
TTCACTGTTCGACCCACGGCGTAACGCGCTTGCTGCTTGGATGCCCGAG
GCATAGACTGTACCCCAAAAAAACAGTCATAACAAGCCATGAAAACCGG
AGAACTCAAGAAAGCAATCCCACCGCACTGTTTCAAACGCTCGATCCCT
CGCTCTTTCTCCTACCTCATCTGGGACATCATCATAGCCTCCTGCTTCT
ACTACGTCGCCACCACTTACTTCCCTCTCCTCCCTCACCCTCTCTCCTA
CTTCGCCTGGCCTCTCTACTGGGCTGCCAAGGGTGCGTCCTAACCGGC
GTCTGGGTCATAGCCCACGAGTGCGGCCACCACGCCTTCAGCGACTAC

Bn476-a (-8):
(SEQ ID NO:53950)
CAGGATCCATGGGTGCAGGTGGAAGAATGCAAGTGTCTCCTCCCTCCAA
GAAGTCTGAAACCGACACCATCAAGCGCGTACCCTGCGAGACACCGCCC
TTCAGAACTCAAGAAAGCAATCCCACCGCACTGTTTCAAACGCTCGATC
CCTCGCTCTTTCTCCTACCTCATCTGGGACATCATCATAGCCTCCTGCT
TCTACTACGTCGCCACCACTTACTTCCCTCTCCTCCCTCACCCTCTCTC
CTACTTCGCCTGGCCTCTCTACTGGGCCTGCCAAGGGTGCGTCCTAACC
GGCGTCTGGGTCATAGCCCACGAGTGCGGCCACCACGCCTTCAGCGACT
AC

Bn482-a (-5):
(SEQ ID NO:53951)
CAGGATCCATGGGTGCAGGTGGAAGAATGCAAGTGTCTCCTCCCTCCAA
GAAGTCTGAAACCGACACCATCAAGCGCGTACCCTGCGAGACACCGCCC
TTCACTGTAACTCAAGAAAGCAATCCCACCGCACTGTTTCAAACGCTCG
ATCCCTCGCTCTTTCTCCTACCTCATCTGGGACATCATCATAGCCTCCT
GCTTCTACTACGTCGCCACCACTTACTTCCCTCTCCTCCCTCACCCTCT
CTCCTACTTCGCCTGGCCTCTCTACTGGGCCTGCCAAGGGTGCGTCCTA
ACCGGCGTCTGGGTCATAGCCCACGAGTGCGGCCACCACGCCTTCAGCG
ACTAC

Bn482-a (-18):
(SEQ ID NO:53952)
CAGGATCCATGGGTGCAGGTGGAAGAATGCAAGTGTCTCCTCCCTCCAA
GAAGTCTGAAACCGACACCATCAAGCGCGTACCCTGCGAGACACCGCCC
TTCAAAGCAATCCCACCGCACTGTTTCAAACGCTCGATCCCTCGCTCTT
TCTCCTACCTCATCTGGGACATCATCATAGCCTCCTGCTTCTACTACGT
CGCCACCACTTACTTCCCTCTCCTCCCTCACCCTCTCTCCTACTTCGCC
TGGCCTCTCTACTGGGCCTGCCAAGGGTGCGTCCTAACCGGCGTCTGGG
TCATAGCCCACGAGTGCGGCCACCACGCCTTCAGCGACTAC

Bn482-b (-74,+5):
(SEQ ID NO:53953)
CAGGATCCATGGGTGCAGGTGGAAGAATGCAAGTGTCTCCTCCCATCAA
GAAAGCAATCCCACCGCACTGTTTCAAACGCTCGATCCCTCGCTCTTTC
TCCTACCTCATCTGGGACATCATCATAGCCTCCTGCTTCTACTACGTCG
CCACCACTTACTTCCCTCTCCTCCCTCACCCTCTCTCCTACTTCGCCTG
GCCTCTCTACTGGGCCTGCCAAGGGTGCGTCCTAACCGGCGTCTGGGTC
ATAGCCCACGAGTGCGGCCACCACGCCTTCAGCGACTAC

Bn482-c (-3):
(SEQ ID NO:53946)
CAGGATCCATGGGTGCAGGTGGAAGAATGCAAGTGTCTCCTCCCTCCAA
GAAGTCTGAAACCGACACCATCAAGCGCGTACCCTGCGAGACACCGCCC
TTCACTGTAGAACTCAAGAAAGCAATCCCACCGCACTGTTTCAAACGCT
CGATCCCTCGCTCTTTCTCCTACCTCATCTGGGACATCATCATAGCCTC
CTGCTTCTACTACGTCGCCACCACTTACTTCCCTCTCCTCCCTCACCCT
CTCTCCTACTTCGCCTGGCCTCTCTACTGGGCCTGCCAAGGGTGCGTCC
TAACCGGCGTCTGGGTCATAGCCCACGAGTGCGGCCACCACGCCTTCAG
CGACTAC

Bn482-e (-3):
(SEQ ID NO:53946)
CAGGATCCATGGGTGCAGGTGGAAGAATGCAAGTGTCTCCTCCCTCCAA
GAAGTCTGAAACCGACACCATCAAGCGCGTACCCTGCGAGACACCGCCC
TTCACTGTAGAACTCAAGAAAGCAATCCCACCGCACTGTTTCAAACGCT
CGATCCCTCGCTCTTTCTCCTACCTCATCTGGGACATCATCATAGCCTC
CTGCTTCTACTACGTCGCCACCACTTACTTCCCTCTCCTCCCTCACCCT
CTCTCCTACTTCGCCTGGCCTCTCTACTGGGCCTGCCAAGGGTGCGTCC
TAACCGGCGTCTGGGTCATAGCCCACGAGTGCGGCCACCACGCCTTCAG
CGACTAC

Bn482-g (-5):
(SEQ ID NO:53954)
CAGGATCCATGGGTGCAGGTGGAAGAATGCAAGTGTCTCCTCCCTCCAA
GAAGTCTGAAACCGACACCATCAAGCGCGTACCCTGCGAGACACCGCCC
TTCACTGGAACTCAAGAAAGCAATCCCACCGCACTGTTTCAAACGCTCG
ATCCCTCGCTCTTTCTCCTACCTCATCTGGGACATCATCATAGCCTCCT
GCTTCTACTACGTCGCCACCACTTACTTCCCTCTCCTCCCTCACCCTCT
CTCCTACTTCGCCTGGCCTCTCTACTGGGCCTGCCAAGGGTGCGTCCTA
ACCGGCGTCTGGGTCATAGCCCACGAGTGCGGCCACCACGCCTTCAGCG
ACTAC

Bn482-h (-6):
(SEQ ID NO:53955)
CAGGATCCATGGGTGCAGGTGGAAGAATGCAAGTGTCTCCTCCCTCCAA
GAAGTCTGAAACCGACACCATCAAGCGCGTACCCTGCGAGACACCGCCC
TTCACTGTACTCAAGAAAGCAATCCCACCGCACTGTTTCAAACGCTCGA
TCCCTCGCTCTTTCTCCTACCTCATCTGGGACATCATCATAGCCTCCTG
CTTCTACTACGTCGCCACCACTTACTTCCCTCTCCTCCCTCACCCTCTC
TCCTACTTCGCCTGGCCTCTCTACTGGGCCTGCCAAGGGTGCGTCCTAA
CCGGCGTCTGGGTCATAGCCCACGAGTGCGGCCACCACGCCTTCAGCGA
CTAA

Bn482-h (-10):
(SEQ ID NO:53940)
CAGGATCCATGGGTGCAGGTGGAAGAATGCAAGTGTCTCCTCCCTCCAA
GAAGTCTGAAACCGACACCATCAAGCGCGTACCCTGCGAGACACCGCCC
TTGAACTCAAGAAAGCAATCCCACCGCACTGTTTCAAACGCTCGATCCC
TCGCTCTTTCTCCTACCTCATCTGGGACATCATCATAGCCTCCTGCTTC
TACTACGTCGCCACCACTTACTTCCCTCTCCTCCCTCACCCACTCTCCT
ACTTCGCCTGGCCTCTCTACTGGGCCTGCCAAGGGTGCGTCCTAACCGG
CGTCTGGGTCATAGCCCACGAGTGCGGCCACCACGCCTTCAGCGACTAA

Bn482-i (+77):
(SEQ ID NO:53956)
CAGGATCCATGGGTGCAGGTGGAAGAATGCAAGTGTCTCCTCCCTCCAA
GAAGTCTGAAACCGACACCATCAAGCGCGTACCCTGCGAGACACCGCCC
TTCACTGTCGGCGCTGCTTGCCGGTGCTGTGCCAGGCCCACGGCTTGAC
CCCGGAGCAGGTGGTGGCCATCGCCAGCCACGATGGCGGAGAACTCAAG
AAAGCAATCCCACCGCACTGTTTCAAACGCTCGATCCCTCGCTCTTTCT
CCTACCTCATCTGGGACATCATCATAGCCTCCTGCTTCTACTACGTCGC
CACCACTTACTTCCCTCTCCTCCCTCACCCTCTCCTCTTCGCCTGG
CCTCTCTACTGGGCCTGCCAAGGGTGCGTCCTAACCGGCGTCTGGGTCA
TAGCCCACGAGTGCGGCCACCACGCCTGCAGCGACTAC

Bn482-i (-2):
(SEQ ID NO:53957)
CAGGATCCATGGGTGCAGGTGGAAGAATGCAAGTGTCTCCTCCCTCCAA
GAAGTCTGAAACCGACACCATCAAGCGCGTACCCTGCGAGACACCGCCC
TTCACTGGGAGAACTCAAGAAAGCAATCCCACCGCACTGTTTCAAACGC
TCGATCCCTCGCTCTTTCTCCTACCTCATCTGGGACATCATCATAGCCT
CCTGCTTCTACTACGTCGCCACCACTTACTTCCCTCTCCTCCCTCACCC
TCTCTCCTACTTCGCCTGGCCTCTCTACTGGGCCTGCCAAGGGTGCGTC
CTAACCGGCGTCTGGGTCATAGCCCACGAGTGCGGCCACCACGCCTTCA
GCGACTAC

TABLE 13B-continued

Sequences of mutant T0 BnaC.Fad2a alleles

Bn482-j (-7):
(SEQ ID NO:53958)
CAGGATCCATGGGTGCAGGTGGAAGAATGCAAGTGTCTCCTCCCTCCAA
AAAGTCTGAAACCGACACCATCAAGCGCGTACCCTGCGAGACACCGCCC
TTCACTAACTCAAGAAAGCAATCCCACCGCACTGTTTCAAACGCTCGAT
CCCTCGCTCTTTCTCCTACCTCATCTGGGACATCATCATAGCCTCCTGC
TTCTACTACGTCGCCACCACTTACTTCCCTCTCCTCCCTCACCCTCTCT
CCTACTTCGCCTGGCCTCTCTACTGGGCCTGCCAAGGGTGCGTCCTAAC
CGGCGTCTGGGTCATAGCCCACGAGTGCGGCCACCACGCCTTCAGCGAC
TAC

Bn482-k (+95):
(SEQ ID NO:53959)
CAGGATCCATGGGTGCAGGTGGAAGAATGCAAGTGTCTCCTCCCTCCAA
GAAGTCTGAAACCGACACCATCAAGCGCGTACCCTGCGAGACACCGCCC
TTCACTGTCGGAATTTATGGAACGTCAGTGGAGCATTTTTAAGACTGAG
CCTTTCGTTTTATCTGTTGTTTGTCGGTGAACGCTCTCCTGAGTAGGAC
AAATCCGGAGAACTCAAGAAAGCAATCCCACCGCACTGTTTCAAACGCT
CGATCCCTCGCTCTTTCTCCTACCTCATCTGGGACATCATCATAGCCTC
CTGCTTCTACTACGTCGCCACCACTTACTTCCCTCTCCTCCCTCACCCT
CTCTCCTACTTCGCCTGGCCTCTCTACTGGGCCTGCCAAGGGTGCGTCC
TAACCGGCGTCTGGGTCATAGCCCACGAGTGCGGCCACCACGCCTTCAG
CGACTAC

Bn482-k (-3):
(SEQ ID NO:53946)
CAGGATCCATGGGTGCAGGTGGAAGAATGCAAGTGTCTCCTCCCTCCAA
GAAGTCTGAAACCGACACCATCAAGCGCGTACCCTGCGAGACACCGCCC
TTCACTGTAGAACTCAAGAAAGCAATCCCACCGCACTGTTTCAAACGCT
CGATCCCTCGCTCTTTCTCCTACCTCATCTGGGACATCATCATAGCCTC
CTGCTTCTACTACGTCGCCACCACTTACTTCCCTCTCCTCCCTCACCCT
CTCTCCTACTTCGCCTGGCCTCTCTACTGGGCCTGCCAAGGGTGCGTCC
TAACCGGCGTCTGGGTCATAGCCCACGAGTGCGGCCACCACGCCTTCAG
CGACTAC

TABLE 13C

Sequences of mutant T0 BnaC.Fad2b alleles

Bn432-a (-13):
(SEQ ID NO:53960)
CAGGATCCATGGGTGCAGGTGGAAGAATGCAAGTCTCTCCTCCCTCCAG
CTCCCCCGAAACCAAAACCCTCAAACGCGTCCCCTGCGAGACACCACCC
TCCTCAAGAAAGCAATCCCACCTCACTGCTTCAAACGCTCCATCCCTCG
CTCCTTCTCCTACCTCCTCTTCGACATCCTCGTCCTCCTCCCTCTAC
CACCTCTCCACAGCCTACTTCCCTCTCCTCCCCCACCCTCTCCCTTCC
TCGCCTGGCCCCTCTACTGGGCCTGCCAAGGCTGCGTCCTAACGGGCCT
CTGGGTCATAGCCCACGAGTGCGGCCACCACGCCTTCAGCGACTAC

Bn432-d (-4,+1):
(SEQ ID NO:53961)
CAGGATCCATGGGTGCAGGTGGAAGAATGCAAGTCTCTCCTCCCTCCAG
CTCCCCCGAAACCAAAACCCTCAAACGCGTCCCCTGCGAGACACCACCC
TTCACTAGAGACCTCAAGAAAGCAATCCCACCTCACTGCTTCAAACGCT
CCATCCCTCGCTCCTTCTCCTACCTCCTCTTCGACATCCTCGTCTCCTC
CCCTCTACCACCTCTCCACAGCCTACTTCCCTCTCCTCCCCCACCCT
CTCCCTTACCTCGCCTGGCCCCTCTACTGGGCCTGCCAAGGCTGCGTCC
TAACGGGCCTCTGGGTCATCGCCCACGAATGCGGCCACCACGCCTTCAG
CGACTAC

TABLE 13C-continued

Sequences of mutant T0 BnaC.Fad2b alleles

Bn432-e (-9):
(SEQ ID NO:53962)
CAGGATCCATGGGTGCAGGTGGAAGAATGCAAGTCTCTCCTCCCTCCAG
CTCCCCCGAAACCAAAGCCCTCAAACGCGTCCCCTGCGAGACACCACCC
TTAGACCTCAAGAAAGCAATCCCACCTCACTGCTTCAAACGCTCCATCC
CTCGCTCCTTCTCCTACCTCCTCTTCGACATCCTCGTCTCCTCCTCCCT
CTACCACCTCTCCACAGCCTACTTCCCTCTCCTCCCCCACCCTCTCCCT
TACCTCGCCTGGCCCCTCTACTGGGCCTGCCAAGGCTGCGTCCTAACGG
GCCTCTGGGTCATCGCCCACGAATGCGGCCACCACGCCTTCAGCGACTA
C

Bn432-f (-4):
(SEQ ID NO:53963)
CAGGATCCATGGGTGCAGGTGGAAGAATGCAAGTCTCTCCTCCCTCCAG
CTCCCCCGAAACCAAAACCCTCAAACGCGTCCCCTGCGAGACACCACCC
TTCACTCTCACCTCAAGAAAGCAATCCCACCTCACTGCTTCAAACGCTC
CATCCCTCGCTCCTTCTCCTACCTCCTCTTCGACATCCTCGTCTCCTCC
TCCCTCTACCACCTCTCCACAGCCTACTTCCCTCTCCTCCCCCACCCTC
TCCCTTACCTCGCCTGGCCCCTCTACTGGGCCTGCCAAGGCTGCGTCCT
AACGGGCCTCTGGGTCATCGCCCACGAATGCGGCCACCACGCCTTCAGC
GACTAC

Bn432-f (+44):
(SEQ ID NO:53964)
CAGGATCCATGGGTGCAGGTGGAAGAATGCAAGTCTCTCCTCCCTCCAG
CTCCCCCGAAACCAAAACCCTCAAACGCGTCCCCTGCGAGACACCACCC
TTCACTCGGAGAATCTCGCTCTCTCCAGGGGAAGCCGAAGTTTCCAAAA
GGTCGGAGACCTCAAGAAAGCAATCCCACCTCACTGCTTCAAACGCTCC
ATCCCTCGCTCCTTCTCCTACCTCCTCTTCGACATCCTCGTCTCCTCCT
CCCTCTACCACCTCTCCACAGCCTACTTCCCTCTCCTCCCCCACCCTCT
CCCTTACCTCGCCTGGCCCCTCTACTGGGCCTGCCAAGGCTGCGTCCTA
ACGGGCCTCTGGGTCATCGCCCACGAATGCGGCCACCACGCCTTCAGCG
ACTAC

Bn432-g (-8):
(SEQ ID NO:53965)
CAGGATCCATGGGTGCAGGTGGAAGAATGCAAGTCTCTCCTCCCTCCAG
CTCCCCCGAAACCAAAACCCTCAAACGCGTCCCCTGCGAGACACCACCC
TTCACTCCTCAAGAAAGCAATCCCACCTCACTGCTTCAAACGCTCCATC
CCTCGCTCCTTCTCCTACCTCCTCTTCGACATCCTCGTCTCCTCCTCCC
TCTACCACCTCTCCACAGCCTACTTCCCTCTCCTCCCCCACCCTCTCCC
TTACCTCGCCTGGCCCCTCTACTGGGCCTGCCAAGGCTGCGTCCTAACG
GGCCTCTGGGTCATCGCCCACGAATGCGGCCACCACGCCTTCAGCGACT
AC

Bn468-c (-7):
(SEQ ID NO:53966)
CAGGATCCATGGGTGCAGGTGGAAGAATGCAAGTCTCTCCTCCCTCCAG
CTCCCCCGAAACCAAAACCCTCAAACGCGTCCCCTGCGAGACACCACCC
TTCACTACCTCAAGAAAGCAATCCCACCTCACTGCTTCAAACGCTCCAT
CCATCGCTCCTTCTCCTACCTCCTCTTCGACATCCTCGTCTCCTCCTCC
CTCTACCACCTCTCCACAGCCTACTTCCCTCTCCTCCCCCACCCTCTCC
CTTACCTCGCCTGGCCCCTCTACTGGGCCTGCCAAGGCTGCGTCCTAAC
GGGCCTCTGGGTCATCGCCCACGAATGCGGCCACCACGCCTTCAGCGAC
TAC

Bn468-d (-7):
(SEQ ID NO:53966)
CAGGATCCATGGGTGCAGGTGGAAGAATGCAAGTCTCTCCTCCCTCCAG
CTCCCCCGAAACCAAAACCCTCAAACGCGTCCCCTGCGAGACACCACCC
TTCACTACCTCAAGAAAGCAATCCCACCTCACTGCTTCAAACGCTCCAT
CCCTCGCTCCTTCTCCTACCTCCTCTTCGACATCCTCGTCTCCTCCTCC
CTCTACCACCTCTCCACAGCCTACTTCCCTCTCCTCCCCCACCCTCTCC
CTTACCTCGCCTGGCCCCTCTACTGGGCCTGCCAAGGCTGCGTCCTAAC
GGGCCTCTGGGTCATAGCCCACGAGTGCGGCCACCACGCCTTCAGCGAC
TAC

TABLE 13C-continued

Sequences of mutant T0 BnaC.Fad2b alleles

Bn468-h (-4,+44):
(SEQ ID NO:53967)
CAGGATCCATGGGTGCAGGTGGAAGAATGCAAGTCTCTCCTCCCTCCAG
CTCCCCCGAAACCAAAACCCTCAAACGCGTCCCCTGCGAGACACCACCC
TTCACTCTGGCTGGCGATGGCCACCACCTGCTCCGGGGTCAAGCCGTGG
GCCGACCTCAAGAAAGCAATCCCACCTCACTGCTTCAAACGCTCCATCC
CTCGCTCCTTCTCCTACCTCCTCTTGACATCCTCGTCTCCTCCTCCCT
CTACCACCTCTCCACAGCCTACTTCCCTCTCCTCCCCCACCCTCTCCCT
TACCTCGCCTGGCCCCTCTACTGGGCTGCCAAGGCTGCGTCCTAACGG
GCCTCTGGGTCATCGCCCACGAATGCGGCCACCACGCCTTCAGCGACTA
C

Bn476-a (+1):
(SEQ ID NO:53968)
CAGGATCCATGGGTGCAGGTGGAAGAATGCAAGTCTCTCCTCCCTCCAG
CTCCCCCGAAACCAAAACCCTCAAACGCGTCCCCTGCGAGACACCACCC
TTCACTCTCGGGAGACCTCAAGAAAGCAATCCCACCTCACTGCTTCAAA
CGCTCCATCCCTCGCTCCTTCTCCTACCTCCTCTTCGACATCCTCGTCT
CCTCCTCCCTCTACCACCTCTCCACAGCCTACTTCCCTCTCCTCCCCCA
CCCTCTCCCTTACCTCGCCTGGCCCCTCTACTGGGCTGCCAAGGCTGC
GTCCTAACGGGCCTCTGGGTCATCGCCCACGAATGCGGCCACCACGCCT
TCAGCGACTAC

Bn476-b (-2):
(SEQ ID NO:53969)
CAGGATCCATGGGTGCAGGTGGAAGAATGCAAGTCTCTCCTCCCTCCAG
CTCCCCCGAAACCAAAACCCTCAAACGCGTCCCCTGCGAGACACCACCC
TTCACTCTGAGAACCTCAAGAAAGCAATCCCACCTCACTGCTTCAAACG
CTCCATCCCTCGCTCCTTCTCCTACCTCCTCTTGACATCCTCGTCTCC
TCCTCCCTCTACCACCTCTCCACAGCCTACTTCCCTCTCCTCCCCCACC
CTCTCCCTTACCTCGCCTGGCCCCTCTACTGGGCTGCCAAGGCTGCGT
CCTAACGGGCCTCTGGGTCATCGCCCACGAATGCGGCCACCACGCCTTC
AGCGACTAC

Bn476-c (-16):
(SEQ ID NO:53970)
CAGGATCCATGGGTGCAGGTGGAAGAATGCAAGTCTCTCCTCCCTCCAG
CTCCCCCGAAACCAAAACCCTCAAACGCGTCCCCTGCGAGACACCACCC
TCAAGAAAGCAATCCCACCTCACTGCTTCAAACGCTCCATCCCTCGCTC
CTTCTCCTACCTCCTCTTGACATCCTCGTCTCCTCCTCCCTCTACCAC
CTCTCCACAGCCTACTTCCCTCTCCTCCCCCACCCTCTCCCTTACCTCG
CCTGACCCCTCTACTGGGCCTGCCAAGGCTGCGTCCTAACGGGCCTCTG
GGTCATAGCCCACGAGTGCGGCCACCACGCCTTCAGCGACTAA

Bn482-a (-4):
(SEQ ID NO:53971)
CAGGATCCATGGGTGCAGGTGGAAGAATGCAAGTCTCTCCTCCCTCCAG
CTCCCCCGAAACCAAAACCCTCAAACGCGTCCCCTGCGAGACACCACCC
TTCACTGAGACCTCAAGAAAGCAATCCCACCTCACTGCTTCAAACGCTC
CATCCCTCGCTCCTTCTCCTACCTCCTCTTGACATCCTCGTCTCCTCC
TCCCTCTACCACCTCTCCACAGCCTACTTCCCTCTCCTCCCCCACCCTC
TCCCTTACCTCGCCTGGCCCCTCTACTGGGCCTGCCAAGGCTGCGTCCT
AACGGGCCTCTGGGTCATCGCCCACGAATGCGGCCACCACGCCTTCAGC
GACTAC

Bn482-c (+29):
(SEQ ID NO:53972)
CAGGATCCATGGGTGCAGGTGGAAGAATGCAAGTCTCTCCTCCCTCCAG
CTCCCCCGAAACCAAAACCCTCAAACGCGTCCCCTGCGAGACACCACCC
TTCACTCTCGGCAAGCAGGCGCTGGAGACGGTCCAGCGGCAGACCTCAA
GAAAGCAATCCCACCTCACTGCTTCAAACGCTCCATCCCTCGCTCCTTC
TCCTACCTCCTCTTCGACATCCTCGTCTCCTCCTCCCTCTACCACCTCT
CCACAGCCTACTTCCCTCTCCTCCCCCACCCTCTCCCTTACCTCGCCTG
GCCCCTCTACTCGGCCTGCCAAGGCTGCGTCCTAACGGGCCTCTGGGTC
ATCGCCCACGAATGCGGCCACCACGCCTTCAGCGACTAC

Bn482-c (-3):
(SEQ ID NO:53973)
CAGGATCCATGGGTGCAGGTGGAAGAATGCAAGTGTCTCCTCCCTCCAA
GAAGTCTGAAACCGACACCATCAAGCGCGTACCCTGCGAGACACCGCCC
TTCACTGTAGAACTCAAGAAAGCAATCCCACCTCACTGCTTCAAACGCT
CCATCCCTCGCTCCTTCTCCTACCTCCTCTCCGACCTCCTCGTCTCATC
CTCCCTCTACCACCTCTCCACAGCCCCCTTCCCTCTCCTCCCCCACCCT
CCCCCTTTCCCCGCCTGGCCCCTCTTCTGAGCCTGCCAAGGCTGCGTCC
TAAAGGGCCTCTGGGTCATAGCCCACGAGTGCGGCCACCACGCCTTCAG
CGACTAC

Bn482-f (-3):
(SEQ ID NO:53974)
CAGGATCCATGGGTGCAGGTGGAAGAATGCAAGTCTCTCCTCCCTCCAG
CTCCCCCGAAACCAAAACCCTCAAACGCGTCCCCTGCGAGACACCACCC
TTCACTCTAGAACTCAAGAAAGCAATCCCACCTCACTGCTTCAAACGCT
CCATCCCTCGCTCCTTCTCCTACCTCCTCTTCGACATCCTCGTCTCCTC
CTCCCTCTACCACCTCTCCACAGCCTACTTCCCTCTCCTCCCCCACCCT
CTCCCTTACCTCGCCTGGCCCCTCTACTGGGCCTGCCAAGGCTGCGTCC
TAACGGGCCTCTGGGTCATCGCCCACGAATGCGGCCACCACGCCTTCAG
CGACTAC

Bn482-j (-3):
(SEQ ID NO:53974)
CAGGATCCATGGGTGCAGGTGGAAGAATGCAAGTCTCTCCTCCCTCCAG
CTCCCCCGAAACCAAAACCCTCAAACGCGTCCCCTGCGAGACACCACCC
TTCACTCTAGACCTCAAGAAAGCAATCCCACCTCACTGCTTCAAACGCT
CCATCCCTCGCTCCTTCTCCTACCTCCTCTTCGACATCCTCGTCTCCTC
CTCCCTCTACCACCTCTCCACAGCCTACTTCCCTCTCCTCCCCCACCCT
CTCCCTTACCTCGCCTGGCCCCTCTACTGGGCCTGCCAAGGCTGCGTCC
TAACGGGCCTCTGGGTCATCGCCCACGAATGCGGCCACCACGCCTTCAG
CGACTAC

Bn482-k (-4):
(SEQ ID NO:53975)
CAGGATCCATGGGTGCAGGTGGAAGAATGCAAGTCTCTCCTCCCTCCAG
CTCCCCCGAAACCAAAACCCTCAAACGCGTCCCCTGCGAGACACCACCC
TTCACTCAGACCTCAAGAAAGCAATCCCACCTCACTGCTTCAAACGCTC
CATCCCTCGCTCCTTCTCCTACCTCCTCTTCGACATCCTCGTCTCCTCC
TCCCTCTACCACCTCTCCACAGCCTACTTCCCTCTCCTCCCCCACCCTC
TCCCTTACCTCGCCTGGCCCCTCTACTGGGCCTGCCAAGGCTGCGTCCT
AACGGGCCTCTGGGTCATCGCCCACGAATGCGGCCACCACGCCTTCAGC
GACTAC

TABLE 14

T1 plants used in crosses

| T1 plant | T0 parent | BnaA.FAD2.a | BnaC.FAD2.a | BnaC.FAD2.b |
| --- | --- | --- | --- | --- |
| Bn432-01 | Bn432-a | −3/−6 | −3, +1/−7 | −13/−13 |
| Bn432-02 | Bn432-a | −3/−6 | −3, +1/−3, +1 | −13/−13 |
| Bn432-03 | Bn432-a | −3/−6 | −7/−7 | −13/−13 |
| Bn432-05 | Bn432-b | −6, +50/−6, +50 | −18, +166/−18, +166 | wt/wt |
| Bn432-07 | Bn432-b | −6, +50/−6, +50 | −18, +166/−18, +166 | wt/wt |

TABLE 15

Mutation profile and oil composition of F2 plants

| F2 plant | Group | Mutation profile of FAD2 genes | | | Oil composition (%) | | |
|---|---|---|---|---|---|---|---|
| | | BnaA.FAD2.a | BnaC.FAD2.a | BnaC.FAD2.b | Oleic acid (18:1) | Linoleic acid (18:2) | Linolenic acid (18:3) |
| Bn432-01 × Bn432-07 F2-04 | 1 | −6, +50/−6, +50 | −18, +166/−18, +166 | −13/−13 | 82.70% | 2.60% | 3.10% |
| Bn432-01 × Bn432-07 F2-02 | 1 | −6, +50/−6, +50 | −18, +166/−18, +166 | −13/−13 | 83.70% | 2.60% | 3.20% |
| Bn432-02 × Bn432-05 F2-02 | 1 | −6, +50/−6, +50 | −18, +166/−18, +166 | −13/−13 | 83.80% | 2.10% | 2.80% |
| Bn432-01 × Bn432-07 F2-03 | 1 | −6, +50/−6, +50 | −18, +166/−18, +166 | −13/−13 | 83.80% | 2.40% | 3.10% |
| Bn432-01 × Bn432-07 F2-01 | 1 | −6, +50/−6, +50 | −18, +166/−18, +166 | −13/−13 | 83.90% | 2.40% | 3.30% |
| Bn432-02 × Bn432-05 F2-01 | 1 | −6, +50/−6, +50 | −18, +166/−18, +166 | −13/−13 | 84.00% | 2.30% | 3.00% |
| Bn432-02 × Bn432-05 F2-05 | 1 | −6, +50/−6, +50 | −3, +1/−18, +166 | −13/−13 | 82.00% | 2.40% | 3.00% |
| Bn432-02 × Bn432-05 F2-07 | 1 | −6, +50/−6, +50 | −3, +1/−18, +166 | −13/−13 | 83.00% | 2.30% | 3.10% |
| Bn432-02 × Bn432-05 F2-08 | 1 | −6, +50/−6, +50 | −3, +1/−18, +166 | −13/−13 | 83.70% | 2.20% | 3.10% |
| Bn432-02 × Bn432-05 F2-06 | 1 | −6, +50/−6, +50 | −3, +1/−18, +166 | −13/−13 | 84.50% | 2.10% | 3.00% |
| Bn432-02 × Bn432-05 F2-04 | 1 | −6, +50/−6, +50 | −3, +1/−18, +166 | −13/−13 | 84.90% | 2.10% | 2.90% |
| Bn432-02 × Bn432-05 F2-03 | 1 | −6, +50/−6, +50 | −3, +1/−3, +1 | −13/−13 | 85.00% | 2.10% | 3.20% |
| Bn432-01 × Bn432-07 F2-12 | 1 | −6, +50/−6, +50 | −7/−18, +166 | −13/−13 | 81.30% | 2.90% | 3.10% |
| Bn432-01 × Bn432-07 F2-09 | 1 | −6, +50/−6, +50 | −7/−18, +166 | −13/−13 | 82.60% | 2.70% | 3.00% |
| Bn432-01 × Bn432-07 F2-11 | 1 | −6, +50/−6, +50 | −7/−18, +166 | −13/−13 | 83.00% | 2.40% | 3.10% |
| Bn432-01 × Bn432-07 F2-08 | 1 | −6, +50/−6, +50 | −7/−18, +166 | −13/−13 | 83.50% | 2.60% | 2.90% |
| Bn432-01 × Bn432-07 F2-10 | 1 | −6, +50/−6, +50 | −7/−18, +166 | −13/−13 | 83.50% | 2.70% | 3.20% |
| Bn432-01 × Bn432-07 F2-07 | 1 | −6, +50/−6, +50 | −7/−18, +166 | −13/−13 | 83.70% | 2.60% | 3.00% |
| Bn432-01 × Bn432-07 F2-13 | 1 | −6, +50/−6, +50 | −7/−18.+166 | −13/−13 | 83.80% | 2.60% | 3.30% |
| Bn432-01 × Bn432-07 F2-06 | 1 | −6, +50/−6, +50 | −7/−7 | −13/−13 | 83.00% | 2.70% | 3.20% |
| Bn432-01 × Bn432-07 F2-05 | 1 | −6, +50/−6, +50 | −7/−7 | −13/−13 | 83.30% | 2.50% | 3.20% |
| Bn432-02 × Bn432-05 F2-09 | 2a | −6, +50/−6, +50 | −18, +166/ −18, +166 | wt/wt | 82.30% | 3.00% | 3.80% |
| Bn432-01 × Bn432-07 F2-14 | 2a | −6, +50/−6, +50 | −18, +166/ −18, +166 | wt/wt | 82.20% | 3.10% | 3.60% |
| Bn432-02 × Bn432-05 F2-10 | 2a | −6, +50/−6, +50 | −3, +1/−3, +1 | wt/wt | 82.30% | 2.60% | 3.60% |
| Bn432-02 × Bn432-05 F2-11 | 2a | −6, +50/−6, +50 | −3, +1/−3, +1 | wt/wt | 81.00% | 3.50% | 3.90% |
| Bn432-02 × Bn432-05 F2-12 | 2a | −6, +50/−6, +50 | −3, +1/−3, +1 | wt/wt | 82.60% | 3.00% | 3.90% |
| Bn432-02 × Bn432-05 F2-13 | 2a | −6, +50/−6, +50 | −3, +1/−3, +1 | wt/wt | 81.70% | 3.00% | 4.20% |
| Bn432-01 × Bn432-07 F2-15 | 2a | −6, +50/−6, +50 | −7/−18, +166 | wt/wt | 81.80% | 3.10% | 3.60% |
| Bn432-02 × Bn432-05 F2-14 | 2b | −3/−3 | −3, +1/−3, +1 | −13/−13 | 83.80% | 2.30% | 3.10% |
| Bn432-02 × Bn432-05 F2-15 | 2b | −3/−3 | −3, +1/−3, +1 | −13/−13 | 84.00% | 2.20% | 3.30% |
| Bn432-01 × Bn432-07 F2-16 | 2b | −6/−6 | −7/−18, +166 | −13/−13 | 82.00% | 2.80% | 3.10% |
| Bn432-01 × Bn432-07 F2-17 | 2b | −6/−6 | −7/−18.+166 | −13/−13 | 82.20% | 2.90% | 3.40% |
| Bn432-01 × Bn432-07 F2-18 | 3 | −6/−6 | −7/−18, +166 | wt/wt | 81.90% | 3.10% | 3.70% |
| Bn432-02 × Bn432-05 F2-17 | 3 | −3/−3 | −18, +166/−18, +166 | wt/wt | 80.80% | 3.50% | 3.40% |
| Bn432-02 × Bn432-05 F2-16 | 3 | −3/−3 | −18, +166/−18, +166 | wt/wt | 80.70% | 3.30% | 3.80% |
| Bn432-01 × Bn432-07 F2-20 | 3 | −6/−6 | −7/−7 | wt/wt | 81.70% | 3.40% | 3.70% |

TABLE 15-continued

Mutation profile and oil composition of F2 plants

| | | Mutation profile of FAD2 genes | | | Oil composition (%) | | |
| --- | --- | --- | --- | --- | --- | --- | --- |
| F2 plant | Group | BnaA.FAD2.a | BnaC.FAD2.a | BnaC.FAD2.b | Oleic acid (18:1) | Linoleic acid (18:2) | Linolenic acid (18:3) |
| Bn432-01 × Bn432-07 F2-19 | 3 | −6/−6 | −7/−18, +166 | wt/wt | 81.40% | 3.40% | 3.30% |
| Wild type cv Westar | 4 | wt/wt | wt/wt | wt/wt | 68.40% | 15.60% | 5.20% |
| Wild type cv Westar | 4 | wt/wt | wt/wt | wt/wt | 66.10% | 17.30% | 6.50% |

TABLE 16

Average oil composition of F2 plants, by group

| | Oil composition (%) | | | Increase/decrease (%)* | | |
| --- | --- | --- | --- | --- | --- | --- |
| Group | Oleic acid (18:1) | Linoleic acid (18:2) | Linolenic acid (18:3) | Oleic acid (18:1) | Linoleic acid (18:2) | Linolenic acid (18:3) |
| 1 | 83.46% | 2.44% | 3.09% | 24.1% | −85.1% | −47.3% |
| 2a | 81.99% | 3.04% | 3.80% | 21.9% | −81.5% | −35.0% |
| 2b | 83.00% | 2.55% | 3.23% | 23.4% | −84.5% | −44.9% |
| 3 | 81.30% | 3.34% | 3.58% | 20.9% | −79.7% | −38.8% |
| 4 | 67.25% | 16.45% | 5.85% | NA | NA | NA |

*Compared to wild type (group 4)

Other Embodiments

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (53975 sequences)

SEQ ID NO: 1 - DNA, 1155 bp, Artificial Sequence
  BnaA.FAD2.a coding sequence
atgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccagggctgcgtcctaaccggcgtctgggtcatagcccacgagtgcggccaccacgccttcagcgactaccagtggctggacgacaccgtcggcctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggcctttgtacttagccttcaacgtctcggggagaccttacgacggcggcttcgcttgccatttccaccccaacgctcccatctacaacgaccgtgagcgtctccagatatacatctccgacgctggcatcctcgccgtctgctacggtctctaccgctacgctgctgtccaaggagttgcctcgatggtctgcttctacggagttcctcttctgattgtcaacgggttcttagttttgatcacttacttgcagcacacgcatccttccctgcctcactatgactcgtctgagtgggattggttgaggggagctttggccaccgttgacagagactacggaatcttgaacaaggtcttccacaatatcacggacacgcacgtggcgcatcacctgttctcgaccatgccgcattatcatgcgatggaagctacgaaggcgataaagccgatactgggagagtattatcagttcgatgggacgccggtggttaaggcgatgtggagggaggcgaaggagtgtatctatgtggaaccggacaggcaaggtgagaagaaaggtgtgttctggtacaacaataagttatga

SEQ ID NO: 2 - DNA, 1155 bp, Artificial Sequence
  BnaC.FAD2.b coding sequence
atgggcgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggcccctctactgggcctgccaaggctgcgtcctaacgggcctctgggtcatcgcccacgaatgcggccaccacgccttcagcgaccaccagtggctggacgacgccgtgggcctcgtcttccactccttcctcctcgtcccttacttctcctggaagtacggccatcgacgccaccattccaacaccggatccctcgagagggatgaagtgctcgtccccaagaagaaatccgacatcaagtggtacggaaagtacctcaacaacccgctaggacgcacggtgatgctaaccgtccagttcacgctcggctggccgttgtacttagccttcaacgtctctggaagaccttacagcgacggtttcgcttgccatttccacccgaacgctcccatctacaacgaccgcgagcgtctccagatatacatctctgacgctggcgtcctctccgtatgttacggtctctaccgctacgctggttcgcgaggagtggcctcgatggtctgtgtctacggagttccgcttatgattgtcaactgtttcctcgtcttgatcacttacttgcagcacacgcacccttcgctgcctcactatgattcttcggagtgggattggttgagaggagctttggctactgtggatagagactatggaatcttgaacaaggtgtttcataacatcacggacacgcacgtggcgcatcatctgttctcgacgatgccgcattataacgcgatggaagcgaccaaggcgataaagccgatacttggagagtattaccagtttgatggaacgccggtggttaaggcgatgtggagggaggcgaaggagtgtatctatgttgaaccggataggcaaggtgagaagaaaggtgtgttctggtacaacaataagttatga

SEQ ID NO: 3 - DNA, 1155 bp, Artificial Sequence
  BnaC.FAD2.a coding sequence
atgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctctactgggcctgccaagggtgcgtcctaaccggcgtctgggtcatagcccacgagtgcggccaccacgccttcagcgactaccagtggcttgacgacaccgtcggtctcatcttccactccttcctcctcgtcccttacttctcctggaagtacagtcatcgacgccaccattccaacactggctccctcgagagagacgaagtgtttgtccccaagaagaagtcagacatcaagtggtacggcaagtacctcaacaaccctttgggacgcaccgtgatgttaacggttcagttcactctcggctggccgttgtacttagccttcaacgtctcgggaagaccttacgacggcggcttcgcttgccatttccaccccaacgctcccatctacaacgaccgcgagcgtctccagatatacatctccgacgctggcatcctcgccgtctgctacggtctcttccgttacgccgccgcgcagggagtggcctcgatggtctgcttctacggagtcccgcttctgattgtcaatggtttcctcgtgttgatcacttacttgcagcacacgcatccttccctgcctcactacgattcgtccgagtgggattggttgaggggagctttggctaccgttgacagagactacggaatcttgaacaaggtcttccacaatattaccgacacgcacgtggcgcatcatctgttctccacgatgccgcattatcacgcgatggaagctaccaaggcgataaagccgatactgggagagtattatcagttcgatgggacgccggtggttaaggcgatgtggagggaggcgaaggagtgtatctatgtggaaccggacaggcaaggtgagaagaaaggtgtgttctggtacaacaataagttatga

SEQ ID NO: 4 - DNA, 1141 bp, Artificial Sequence
  BnaA.FAD2.b-like coding sequence
atgggcgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttacctcgcctgacccctctactgggcctgccaaggctgcgtcctaacgggcctctgggtcatagcccacgagtgcggccaccacgccttcagcgaccaccagtggctggacgacgccgccggcctcgtcttccactccttcctcctcgtcccgtacttctcctggaagtacatccatgacgccaccattccaacaccggatccctcgatagggacgaagtgttcgtccccaagaagaaatccgacatcaagtggtacggcaagtacctcaacaacccgctaggacgcacggtgatgctaaccgtccagttcaagctcggctggccgttgtacttagccttcaacgtctcgggaagaccttacagcgacggtttcgcttgccatttccacccgaacgctcccatctacaacgaccgcgagcgtctccagatatacatctctgacgctggcgtcctctccgtatgttacggtctctaccgttacgctgcttcgcgaggagtagcctctgtggtctgtgtctacggagttccgcttctaattgtcaactgtttcctcgtcttgatcacttacttgcagcacacgcacccttcgctgcctcactatgattcttccgagtgggattggttgagaggagctttggctactgtggatagagactatggaatcttgaacaaggtgttccataacatcacggacacgcacgtggcgcatcatctgttctcgacgatgccgcattataacgcgatggaagcgaccaaggcgataaagccgatactttggagagtattaccagtttgatggaacgccggcggttaaggcgatgtggagggaggcgaaggagtgtatctatgttgaaccggataggcaaggtgagaagaaaggtgtgttctggtacaacaataagttatga

SEQ ID NO: 5 - DNA, 28 bp, Artificial
  FAD2.a forward primer
caggatccatgggtgcaggtggaagaat

SEQ ID NO: 6 - DNA, 28 bp, Artificial
  FAD2.b forward primer
caggatccatgggcgcaggtggaagaat

SEQ ID NO: 7 - DNA, 30 bp, Artificial
  FAD2 reverse primer
cagagctctcataacttattgttgtaccag

SEQ ID NO: 8 - DNA, 49 bp, Artificial
  Target site for BnFAD2_T01
tccctcaccctctctcctacttcgcctggcctctctactgggcctgcca

SEQ ID NO: 9 - DNA, 49 bp, Artificial
  Target site for BnFAD2_T02
tcgtcccttacttctcctggaagtacagtcatcgacgccaccattccaa

SEQ ID NO: 10 - DNA, 48 bp, Artificial
  Target site for BnFAD2_T03
tgcgagacaccgcccttcactgtcggagaactcaagaaagcaatccca

SEQ ID NO: 11 - DNA, 49 bp, Artificial
  Target site for BnFAD2_T04
tacctcatctgggacatcatcatagcctcctgcttctactacgtcgcca

SEQ ID NO: 12 - DNA, 49 bp, Artificial
  Target site for BnFAD2_T05
tctgggtcatagcccacgagtgcggccaccacgccttcagcgactacca

SEQ ID NO: 13 - DNA, 50 bp, Artificial
  Target site for BnFAD2_T06
tccttctcctacctcctcttcgacatcctcgtctcctcctccctctacca

SEQ ID NO: 14 - DNA, 49 bp, Artificial
  Target site for BnFAD2_T07
tctgggtcatcgcccacgaatgcggccaccacgccttcagcgaccacca

SEQ ID NO: 15 - DNA, 49 bp, Artificial
  Predicted binding site for BnFAD2_T01 within BnaC.FAD2.b
tcccccaccctctcccttacctcgcctggcccctctactgggcctgcca

SEQ ID NO: 16 - DNA, 34 bp, Artificial
  Predicted binding site for BnFAD2_T01 within BnaA.FAD2.b-like
cttacctcgcctgacccctctactgggcctgcca

SEQ ID NO: 17 - DNA, 49 bp, Artificial
  Predicted binding site for BnFAD2_T02 within BnaC.FAD2.b
tcgtcccttacttctcctggaagtacggccatcgacgccaccattccaa

SEQ ID NO: 18 - DNA, 48 bp, Artificial
  Predicted binding site for BnFAD2_T02 within BnaA.FAD2.b-like
tcgtcccgtacttctcctggaagtacatccatgacgccaccattccaa

SEQ ID NO: 19 - DNA, 48 bp, Artificial
  Predicted binding site for BnFAD2_T03 within BnaC.FAD2.b
tgcgagacaccacccttcactctcggagacctcaagaaagcaatccca

SEQ ID NO: 20 - DNA, 48 bp, Artificial
  Predicted binding site for BnFAD2_T03 within BnaA.FAD2.b-like
tgcgagacaccaccattcactctcggagacctcaagaaagcaatccca

SEQ ID NO: 21 - DNA, 49 bp, Artificial
  Predicted binding site for BnFAD2_T04 within BnaC.FAD2.b
tacctcctcttcgacatcctcgtctcctcctccctctaccacctctcca

SEQ ID NO: 22 - DNA, 50 bp, Artificial
  Predicted binding site for BnFAD2_T04 within BnaA.FAD2.b-like
tcttcgacatcatcatctcctcctcggctcctccctctaccacctctcca

SEQ ID NO: 23 - DNA, 49 bp, Artificial
  Predicted binding site for BnFAD2_T05 within BnaA.FAD2.b-like
tctgggtcatagcccacgagtgcggccaccacgccttcagcgaccacca

SEQ ID NO: 24 - DNA, 50 bp, Artificial
  Predicted binding site for BnFAD2_T06 within BnaA.FAD2.a
tctttctcctacctcatctgggacatcatcatagcctcctgcttctacta

SEQ ID NO: 25 - DNA, 50 bp, Artificial; identical to SEQ ID NO: 24
  Predicted binding site for BnFAD2_T06 within BnaC.FAD2.a

SEQ ID NO: 26 - DNA, 51 bp, Artificial
  Predicted binding site for BnFAD2_T06 within BnaA.FAD2.b-like
tccttctcctcttcgacatcatcatctcctcctcggctcctccctctacca

SEQ ID NO: 27 - DNA, 49 bp, Artificial; identical to SEQ ID NO: 12
  Predicted binding site for BnFAD2_T07 within BnaC.FAD2.a

SEQ ID NO: 28 - DNA, 49 bp, Artificial; identical to SEQ ID NO: 12
  Predicted binding site for BnFAD2_T07 within BnaC.FAD2.a

SEQ ID NO: 29 - DNA, 49 bp, Artificial; identical to SEQ ID NO: 23
  Predicted binding site for BnFAD2_T07 within BnaA.FAD2.b-like

SEQ ID NO: 30 - DNA, 21 bp, Artificial
  Binding sequence for primer BnFA353R-HTS
ggtagtcgctgaaggcgtggt

SEQ ID NO: 31 - DNA, 21 bp, Artificial
  Binding sequence for primer BnFA231F-HTS
cctctcctccctcaccctctc

SEQ ID NO: 32 - DNA, 23 bp, Artificial
  Binding sequence for primer BnFA591R-HTS
gctaagtacaaaggccagccgag

SEQ ID NO: 33 - protein, 5 aa, Artificial
  Conserved sequence within EPSPS
TAMRP

SEQ ID NO: 34 - protein, 9 aa, Artificial
  Consensus sequence for the dodecapeptide family of meganucleases
LAGLIDADG

SEQ ID NO: 35 - protein, 6 aa, Artificial
  Conserved amino acid sequence within functional FAD2 proteins in Brassica napus
HECGHH

SEQ ID NO: 36 - protein, 5 aa, Artificial
  Conserved amino acid sequence within functional FAD2 proteins in Brassica napus
HRRHH

SEQ ID NO: 37 - protein, 5 aa, Artificial
  Conserved amino acid sequence within functional FAD2 proteins in Brassica napus
HVAHH

SEQ ID NO: 38 - protein, 5 aa, Artificial
  Conserved amino acid sequence within functional FAD2 proteins in Brassica napus
YNNKL

SEQ ID NO: 39 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttggcccctctactgggcctgccaaggctgcgtcctaacgggcctctgggtcatcgcccacgaatgcggccaccacgccttcagcgactac

SEQ ID NO: 40 - DNA, 341 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctggcccctctactgggcctgccaaggctgcgtcctaacgggcctctgggtcatcgcccacgaatgcggccaccacgccttcagcgactac

SEQ ID NO: 41 - DNA, 312 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctcaccctctctcctacttggcctctctactgggcctgccagggctgcgtcctaacgggcctctgggtcatagcccacgagtgcggccaccacgccttcagcgactac

SEQ ID NO: 42 - DNA, 261 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttaccacgccttcagcgactac

SEQ ID NO: 43 - DNA, 338 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccccctctactgggcctgccaaggctgcgtcctaacgggcctctgggtcatagcccacgagtgcggccaccacgccttcagcgactac

SEQ ID NO: 44 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccccctctactgggcctgccaaggctgcgtcctaacgggcctctgggtcatcgcccacgaatgcggccaccacgccttcagcgactac

SEQ ID NO: 45 - DNA, 310 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctcaccctctctcctatggcctctctactgggcctgccaagggtgcgtcctaaccggcgtctgggtcatagcccacgagtgcggccaccacgccttcagcgactac

SEQ ID NO: 46 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 47 - DNA, 275 bp, Artificial
  Mutation in BnaC.FAD2.b introduced by TALE nuclease pair BnFAD2_T01
caggatccatgggtgcaggtggaagaatgcaagtctctcctccctccagctcccccggaaccgacaccatcaagcgcgtaccctgcgagacaccgcccttcactgtcggagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttaccacgccttcagcgactac

SEQ ID NO: 48 - DNA, 350 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatcccacgctccttctcctcttcgacatcatcatctcctcctcggctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 49 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctgccctctactgggcctgccaaggctgcgtcctaacgggcctctgggtcatcgcccacgaatgcggccaccacgccttcagcgactac

SEQ ID NO: 50 - DNA, 349 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 51 - DNA, 357 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccccccccctctcccttacctcgccacctggcccctctactgggcctgccaaggctgcgtcctaacgggcctctgggtcatcgcccacgaatgcggccaccacgccttcagcgactac

SEQ ID NO: 52 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcccctctactgggcctgccaaggctgcgtcctaacgggcctctgggtcatcgcccacgaatgcggccaccacgccttcagcgactaa

SEQ ID NO: 53 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcctccaccctctcccttacctcgccggcccctctactgggcctgccaaggctgcgtcctaacgggcctctgggtcatcgcccacgaatgcggccaccacgccttcagcgactac

SEQ ID NO: 54 - DNA, 373 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctctccagcgcctgcttgccgccatcgtgcccctctactgggcctgccaaggctgcgtcctaacgggcctctgggtcatcgcccacgaatgcggccaccacgccttcagcgactac

SEQ ID NO: 55 - DNA, 353 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctaccgccctggcctctctactgggcctgccagggctgcgtcctaaccggcgtctgggtcatagcccacgagtgcggccaccacgccttcagcgactac

SEQ ID NO: 56 - DNA, 321 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcctcgtctcctcctccctctaccacctctccacagcctacttccctctcctcccccaccctctctcaagggtgcgtcctaaccggcgtctgggtcatagcccacgagtgcggccaccacgccttcagcgactac

SEQ ID NO: 57 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacccctggcccctctactgggcctgccaaggctgcgtcctaacgggcctctgggtcatcgcccacgaatgcggccaccacgccttcagcgactac

SEQ ID NO: 58 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatccttgtctcctcctccctctaccacctctccacagcctacttccctctcctcccccaccctctcccttacctctggcccctctactgggcctgccaaggctgcgtcctaaccggcgtctgggtcatagcccacgagtgcggccaccacgccttcagcgactac

SEQ ID NO: 59 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctgccctctactgggcctgccaaggctgcgtcctaacgggcctctgggtcatcgcccacgaatgcggccaccacgccttcagcgactac

SEQ ID NO: 60 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 61 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatagcccacgagtgcggccaccacgccttcagcgactac

SEQ ID NO: 62 - DNA, 329 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctactgccaagggtgcgtcctaacgggcctctgggtcatagcccacgagtgcggccaccacgccttcagcgactac

SEQ ID NO: 63 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgagtgcggccaccacgccttcagcgactac

SEQ ID NO: 64 - DNA, 318 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcatcatctcctcctcggctcctccctcaccctctctcctactctcctctctactgggcctgccaagggtgcgtcctaaccggcgtctgggtcatagcccacgagtgcggccaccacgccttcagcgactac

SEQ ID NO: 65 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttatggcccctctactgggcctgccaaggctgcgtcctaacgggcctctgggtcatcgcccacgaatgcggccaccacgccttcagcgactac

SEQ ID NO: 66 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctgcccctctactgggcctgccaaggctgcgtcctaacgggcctctgggtcatcgcccacgaatgcggccaccacgccttcagcgactac

SEQ ID NO: 67 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgctccaaacgctccatcccacgctccttctcctcttcgacatcatcatctcctcctcggctcctccctctaccacctctccacagcctacttccctctcctcccccaccctctcccttacccctctactgggcctgccaaggctgcgtcctaacgggcctctgggtcatcgcccacgaatgcggccaccacgccttcagcgactac

SEQ ID NO: 68 - DNA, 345 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcgcctggcccctctactgggcctgccaaggctgcgtcctaacgggcctctgggtcatagcccacgagtgcggccaccacgccttcagcgactac

SEQ ID NO: 69 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagccacgatggcggcaagcaggcgctggagcctggcccctctactggacctgccaaggctgcgtcctaacgggcctctgggtcatcgcccacgaatgcggccaccacgccttcagcgactac

SEQ ID NO: 70 - DNA, 373 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaacacctctccacagcctacttccctctcctcccccaccctctcccttccctctccagcgcctgcttgccgccatcgtgcccctctactgggcctgccaaggctgcgtcctaacgggcctctgggtcatagcccacgagtgcggccaccacgccttcagcgactac

SEQ ID NO: 71 - DNA, 336 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgccttcagcgactac

SEQ ID NO: 72 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 73 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctcaccactgcctacttccctctcctccccccccctctccccttcccctggcccctctactgggcctgccaaggctgcgtcctaacgggcctctgggtcatcgcccacgaatgcggccaccacgccttcagcgactac

SEQ ID NO: 74 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccgggcccctctactgggcctgccaaggctgcgtcctaacgggcctctgggtcatcgcccacgaatgcggccaccacgcctcagcgactac

SEQ ID NO: 75 - DNA, 338 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtccactgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccccccccatctccccccctactgggcctgccaagcctgcgtcctaacgggcctcggggtcatcgcccacgaatgcggccaccacgccttcagcgactac

SEQ ID NO: 76 - DNA, 319 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctcctacttcgcccctggcctctctactgggcctgccaagggtgcgtcctaaccggcgtctgggtcatagcccacgagtgcggccaccacgccttcagcgactac

SEQ ID NO: 77 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaaacaatcccacctcactgcttcaaacgctccatcccacgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 78 - DNA, 346 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttatggcccctctactgggcctgccaaggctgcgtcctaacgggcctctgggtcatcgcccacgaatgcggccaccacgccttcagcgactac

SEQ ID NO: 79 - DNA, 335 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttaccttggcccctctactgggcctgccaaggctgcgtcctaacgggcctctgggtcatcgcccacgaatgcggccaccacgccttcagcgactac

SEQ ID NO: 80 - DNA, 412 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttcccgcgctggagacggtccagcggctgttgccggtgctgtgccaggcccacggcttgaccccggagctggcccctctactgggcctgccaaggctgcgtcctaacgggcctctgggtcatagcccacgagtgcggccaccacgccttcagcgactac

SEQ ID NO: 81 - DNA, 336 bp, Artificial
  Mutation in BnaC.FAD2.b introduced by TALE nuclease pair BnFAD2_T01
caggtccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccctctactgggcctgccaaggctgcgtcctaaccggcgtctgggtcatagcccacgagtgcggccaccacgccttcagcgactac

SEQ ID NO: 82 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 83 - DNA, 346 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctccccccccctctcccttaccccccctctactgggcctgccaaggctgcgtcctaacgggcctctgggtcatcgcccacgaatgcggccaccacgccttcagcgactac

SEQ ID NO: 84 - DNA, 260 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcccttaccacgccttcagcgactac

SEQ ID NO: 85 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 86 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgctggcccctctactgggcctgccaagggtgcgtcctaacgggcctctgggtcatcgcccacgaatgcggccaccacgccttcagcgactac

SEQ ID NO: 87 - DNA, 451 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctccttccctctcctcccccaccctctccctcaccccggccttgatcatctcgccgccgatcaggagctcctccacggacagcacggcgccgtttcgttttatttgatgcctggcagttccctactctcgcgttcgaatacatctagatccaagcctgccaaggctgcgtcctaacgggcctctgggtcatcgcccacgagtgcggccaccacgccttcagcgactac

SEQ ID NO: 88 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctctccctggcccctctactgggcctgccaaggctgcgtcctaacgggcctctgggtcatagcccacgagtgcggccaccacgccttcagcgactac

SEQ ID NO: 89 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctccgcctggcccctctactgggcctgccaaggctgcgtcctaacgggcctctgggtcatcgcccacgaatgcggccaccacgccttcagcgactac

SEQ ID NO: 90 - DNA, 398 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctaccttacctcgctggagacggtccagcggatgttgccggtgctgtgccaggcccacggcttgaccccggagctggcccctctactgggcctgccaaggctgcgtcctaacgggcctctgggtcatcgcccacgaatgcggccaccacgccttcagcgactac

SEQ ID NO: 91 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttggcccctctactgggcctgccaaggctgcgtcctaacgggcctctgggtcatcgcccacgaatgcggccaccacgccttcagcgactac

SEQ ID NO: 92 - DNA, 349 bp, Artificial
  Mutation in BnaC.FAD2.b introduced by TALE nuclease pair BnFAD2_T01
caggatccatgggtgcaggtggaagaatgcaagtctctcctccctccagctccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctctggcccctctactgggcctgccaaggctgcgtcctaacgggcctctgggtaatcgcccacgaatgcggccaccacgccttcagcgactac

SEQ ID NO: 93 - DNA, 394 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctaagggcgagatccggtgcagattatttggattgagagtgaatattgcccctctactgggcctgccaaggctgcgtcctaacgggcctctgggtcatcgcccacgagtgcggccaccacgccttcagcgactac

SEQ ID NO: 94 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaaccggcgtctgggtcatagcccacgagtgcggccaccacgccttcagcgactac

SEQ ID NO: 95 - DNA, 345 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaacgggcctctgggtcatcgcccacgaatgcggccaccacgccttcagcgactac

SEQ ID NO: 96 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcgctgcttcaaacgctccttcccacgctccttctcctcttcgacatcatcatctcctcctcggctcctccctctaccacctctccccagcctacttccctctcctccctcaccctctctcctactctggcctctctactgggcctgccaagggtgcgtcctaaccggcgtctgggtcatagcccacgagtgcggccaccacgccttcagcgactac

SEQ ID NO: 97 - DNA, 389 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccacccacgtataaaccgtcgatgccctgctgaatattgaactgaaccaggcgactggcctctctactgggcctgccaagggtgcgtcctaaccggcgtctgggtcatagcccacgagtgcggccaccacgccttcagcgactac

SEQ ID NO: 98 - DNA, 356 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccgcctggcccctctactgggcctgccaaggctgcgtcctaacgggcctctgggtcatcgcccacgaatgcggccaccacgccttcagcgactac

SEQ ID NO: 99 - DNA, 338 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatcccacgctccttctcctcttcgacatcatcatctcctcctcggctcctccctctaccacctctccacagcctacttccctctcccttacctcgcctgaccctctactgggcctgccaaggctgcgtcctaacgggcctctgggtcatagcccacgagtgcggccaccacgccttcagcgactac

SEQ ID NO: 100 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatagcccacgagtgcggccaccacgccttcagcgactac

SEQ ID NO: 101 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 102 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctaggagacctcaagaaagcaatcccacctcactgcttcaaacgctccatcccacgctccttctcctcttcgacatcatcatctcctcctcggctcctccctctaccacctctccacagcctacttccctctcctccccccccctctcccttacccctctactgggcctgccaaggctgcgtcctaacgggcctctgggtcatcgcccacgaatgcggccaccacgccttcagcgactac

SEQ ID NO: 103 - DNA, 345 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacgcctctctactgggcctgccaaggctgcgtcctaacgggcctctgggtcatagcccacgagtgcggccaccacgccttcagcgactac

SEQ ID NO: 104 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccggaactaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctgcccctctactgggcctgccaaggctgcgtcctaacgggcctctgggtcatcgcccacgaatgcggccaccacgccttcagcgactac

SEQ ID NO: 105 - DNA, 351 bp, Artificial
  Mutation in BnaC.FAD2.b introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcggcctctctactgggcctgccaagggtgcgtcctaaccggcgtctgggtaatagcccacgagtgcggccaccacgccttcagcgactac

SEQ ID NO: 106 - DNA, 261 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttccctctcccttaccacgccttcagcgactac

SEQ ID NO: 107 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcccctctactgggcctgccaaggctgcgtcctaacgggcctctgggtcatcgcccacgaatgcggccaccacgccttcagcgactac

SEQ ID NO: 108 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatagcccacgagtgcggccaccacgccttcagcgactac

SEQ ID NO: 109 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacacttcactctcggagacctcaagaaagcaatcccacctcactgcttcaaacgctccatccctcgctccttctcctacctcctcttcgacatcctcgccgcctcctccctctaccacctctccacagcctacttccctctcctccctcaccctctctcctacctcctctctactgggcctgccagggctgcgtcctaacccgcgtctggggcatagcccacgagtgcggccaccacgccttcagcgactac

SEQ ID NO: 110 - DNA, 339 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatcccacgctccttctcctcttcgacatcctcgtctcctcctccctctaccacctctccacagcctacttccctctcctccccccccctcccccttacctcgcctctactgggcctgccaaggctgcgtcctaacgggcctctgggtcatcgcccacgaatgcggccaccacgccttcagcgactac

SEQ ID NO: 111 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcccctctactgggcctgccaaggctgcgtcctaacgggcctctgggtcatcgcccacgaatgcggccaccacgccttcagcgactac

SEQ ID NO: 112 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctgcctctctactgggcctgccaagggtgcgtcctaaccggcgtctgggtcatagcccacgagtgcggccaccacgccttcagcgactac

SEQ ID NO: 113 - DNA, 353 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcgtctcctcctccctctaccacctctccacagcctacttccctctcctcccccaccctctcccttaccttggcccctctactgggcctgccaaggctgcgtcctaacgggcctctgggtcatagcccacgagtgcggccaccacgccttcagcgactac

SEQ ID NO: 114 - DNA, 356 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccgcctggcccctctactgggcctgccaaggctgcgtcctaacgggcctctgggtcatcgcccacgaatgcggccaccacgccttcagcgactac

SEQ ID NO: 115 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttccctgcccctctactgggcctgccaaggctgcgtcctaacgggcctctgggtcatcgcccacgaatgcggccaccacgccttcagcgactac

SEQ ID NO: 116 - DNA, 381 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccgtaccccgctcgccgcagccgaacgaccgagcgcagcgtggcccctctactgggcctgccaaggctgcgtcctaacgggcgtctgggtcatagcccacgagtgcggccaccacgccttcagcgactac

SEQ ID NO: 117 - DNA, 400 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccatctaccacctctccacagcctacttccctctcctcccccaccctctccttacctggcctcgggcatccaagcagcaagcgcgttacgccgtgggtcgatgtttgactggcccctctactgggcctgccaaggctgcgtcctaacgggcctctgggtcatcgcccacgaatgcggccaccacgccttcagcgactac

SEQ ID NO: 118 - DNA, 350 bp, Artificial
  Mutation in BnaC.FAD2.b introduced by TALE nuclease pair BnFAD2_T01
caggatccatgggtgcaggtggaagaatgcaagtgtctcctccatccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcggcctctctactgggcctgccaagggtgcgtcctaaccggcgtctgggtcatagcccacgagtgcggccaccacgccttcagcgactac

SEQ ID NO: 119 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctccctctaccacctctccacagcctacttccctctcctcccccaccctctcccttacctctggcccctctacggggcctgccaaggctgcgtcctaacgggcctctgggtcatcgcccacgaatgcggccaccacgccttcagcgactac

SEQ ID NO: 120 - DNA, 356 bp, Artificial
  Mutation in BnaC.FAD2.b introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctccaccacccctccacagcctacttccctctcctcccccaccctctcccttccctcgccgcctggcccctctactgggcctgccaaggctgcgtcctaacgggcctctgggtcatcgcccacgaatgcggccaccacgccttcagcgactac

SEQ ID NO: 121 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccccctcccttacctggcccctctactgggcctgccaaggctgcgtcctaacgggcctctgggtcatcgcccacgagtgcggccaccacgccttcagcgactac

SEQ ID NO: 122 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctgcccctctactgggcctgccaagggtgcgtcctaaccggcgtctgggtcatagcccacgagtgcggccaccacgccttcagcgactac

SEQ ID NO: 123 - DNA, 308 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctcaccctctctcctagcctctctactgggcctgccaagggtgcgtcctaaccggcgtctgggtcatagcccacgagtgcggccaccacgccttcagcgactac

SEQ ID NO: 124 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccctggcccctctactgggcctgccaaggctgcgtcctaacgggcctctgggtcatcgcccacgaatgcggccaccacgccttcagcgactac

SEQ ID NO: 125 - DNA, 372 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctccagcggctgttgccgccatcgtgcccctctactgggcctgccaaggctgcgtcctaacgggcctctgggtcatcgcccacgaatgcggccaccacgccttcagcgactac

SEQ ID NO: 126 - DNA, 261 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttaccacgccttcagcgactac

SEQ ID NO: 127 - DNA, 341 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctggcccctctacggggcctgccaatggtgcgtcctaaccggcgtctgggtcatagcccacgagtgcggccaccacgccttcagcgactac

SEQ ID NO: 128 - DNA, 343 bp, Artificial
  Mutation in BnaC.FAD2.b introduced by TALE nuclease pair BnFAD2_T01
caggatccatgggtgcaggtggaagaatgcaagtgtctcatccctccaaaaagtctgaaaccgacaacatcaagcgcgtaccctgcgagacaccgcccttcactgtcggagaactcaagaaagcaatcccaccgcactgtttcaaacgctccatcccacgctccttctcctcttcgacatcctcgtctcctcctccctctaccacctctccacagcctacttccctctcctcccccaccctctcccttacctctggcccctctactgggcctgccaaggctgcgtcctaccgggcctctgggtcatcgcccacgagtgcggccaccacgccttcagcgactac

SEQ ID NO: 129 - DNA, 348 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatccctcgctccttctcctacctcctcttcgacatcctcgtctcctcctccctctaccacctctccacagcctacttccctctcctcccccaccctctccctgccatggcccctctacggggcctgccaaggctgcggcctaacgggcctctggggcagagcccacgaatgaggccaccacgccgtcagcgacgac

SEQ ID NO: 130 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacccctggcccctctactgggcctgccaaggctgcgtcctaacgggcctctgggtcatcgcccacgagtgcggccaccacgccttcagcgactac

SEQ ID NO: 131 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctgcccctctacggggcctgccaaggctgcgtcctaacgggcctctgggtcatcgcccacgaatgcggccaccacgccttcagcgactac

SEQ ID NO: 132 - DNA, 326 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccctctactgggcctgccaaggctgcgtcctaacgggcctctgggtcatcgcccacgaatgcggccaccacgccttcagcgactac

SEQ ID NO: 133 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttccctgcccctctactgggcctgccaaggctgcgtcctaacgggcctctgggtcatcgcccacgaatgcggccaccacgccttcagcgactac

SEQ ID NO: 134 - DNA, 380 bp, Artificial
  Mutation in BnaC.FAD2.b introduced by TALE nuclease pair BnFAD2_T01
caggatccatggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttcccccgctcgccgcagccgaccgaccgagcgcagcgtggcccctctactgggcctgccaaggctgcgtcctaacgggcctctgggtcatagcccacgagtgcggccaccacgccttcagcgactac

SEQ ID NO: 135 - DNA, 336 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcatcggctcctccctctaccacctctccacagcctacttccctctcccttacctctggcccctctactgggcctgccaaggctgcgtcctaacgggcctctgggtcatcgcccacgaatgcggccaccacgccttcagcgactac

SEQ ID NO: 136 - DNA, 334 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttacctggcccctctactgggcctgccaaggctgcgtcctaacgggcctctgggtcatagcccacgagtgcggccaccacgccttcagcgactac

SEQ ID NO: 137 - DNA, 331 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccctggcccctctactgggcctgccaaggctgcgtcctaacgggcctctgggtcatagcccacgagtgcggccaccacgccttcagcgactac

SEQ ID NO: 138 - DNA, 351 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 139 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccaccccacgctccttctcctcttcgacatcatcatctcctcctcggctcctccctctaccacctctccacagcctacttccctctcctcccccacccccgcccttacctggcccctctacagggcctgccaaggctgcgtcctaacgggcctctgggtcatagcccacgagtgcggccaccacgccttcagcgactac

SEQ ID NO: 140 - DNA, 425 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttgcggatttgaacgttgtgaagcaacggcccggagggtggcgggccaccccctgctggggggtcaagccgtgggcctggcccctctactgggcctgccaaggctgcgtcctaacgggcctctgggtcatcgcccacgaatgcggccaccacgccttcagcgactac

SEQ ID NO: 141 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaacccaaccccctcaaccgcgtcccctccgagcccccaccattcactctcggagacctcaagaaaccaatcccacctcactgcttcaaacgctccatcccccgctccttctcctccctcctcttcgacatcctcgcctcctcctccctctaccacctctccacagcctacttccctctcctcccccaccctctcccttacctcccctctactgggcctgccaaggctgcgtcctaacgggcctctgggtcatcgcccacgaatgcggccaccacgccttcagcgactac

SEQ ID NO: 142 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcccctctactgggcctgccgaggctgcgtcctaacgggcctctgggtcatagcccacgagtgcggccaccacgccttcagcgactac

SEQ ID NO: 143 - DNA, 327 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttacctctactgggcctgccaagggtgcgtcctaaccggcgtctgggtcatagcccacgagtgcggccaccacgccttcagcgactac

SEQ ID NO: 144 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctggcccctctactgggcctgccaaggctgcgtcctaaccggggtctgggtcatagcgcacgagtgcggccaccacgccttcatcgactac

SEQ ID NO: 145 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 146 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccctggcccctctacggggcctgccaaggctgcgtcctaacgggcctctgggtcatcgcccacgaatgcggccaccacgccttcagcgactac

SEQ ID NO: 147 - DNA, 346 bp, Artificial
  Mutation in BnaC.FAD2.b introduced by TALE nuclease pair BnFAD2_T01
caggatccatgggtgcaggtggaagaatgcaagtctctcctccctccagctccctcgaaaccaaaaccctcacacgcgtcccctgcgagacaccaccctccactctcgtggacctcaagaaagcaatcccacctcactgcttaaaacgcttcatccctcgctccttctcctatctcctcttcgacatcctcgtctcctcctccctctaccacctctccacagcctacttccctctccacccccaccctctcccctaccaccccccttctgcgcctaccaaggctgcgtcctaacgggcctctgggtcatctcccacgaatgcggccaccgcgcctgcaacgactac

SEQ ID NO: 148 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacccctctactgggcctgccaaggctgcgtcctaacgggcctctgggtcatcgcccacgaatgcggccaccacgccttcagcgactac

SEQ ID NO: 149 - DNA, 338 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccccctctactgggcctgccaaggctgcgtcctaacgggcctctgggtcatcgcccacgaatgcggccaccacgccttcagcgactac

SEQ ID NO: 150 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 151 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcccctctactgggcctgccaaggctgcgtcctaacgggcctctgggtcatcgcccacgaatgcggccaccacgccttcagcgactac

SEQ ID NO: 152 - DNA, 310 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctgggtctgccaaggctgcgtcctaacgggcctgggtcatcgcccacgaatgcggccaccacgccttcagcgactcc

SEQ ID NO: 153 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacccctggcccctctactgggcctgccaaggctgcgtcctaacgggcctctgggtcatagcccacgagtgcggccaccacgccttcagcgactac

SEQ ID NO: 154 - DNA, 312 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctgggtctgccaaggctgcgtcctaacgggcctctgggtcatcgcccacgaatgcgtccaccacgccttcagcgactac

SEQ ID NO: 155 - DNA, 351 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctctctgcttcaaacgctccatcccacgctccttctcctcttcgacatcatcatctcctcctcggctcctccctctaccacctctccacagcctacttccctctcctcccccaccctctcccttacctctggcccctctactgggcctgccaaggctgcgtcctcacgggcctctgggtcatcgcccacgaatgcggccaccacgccttcagcgactac

SEQ ID NO: 156 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttggcctctctactgggcctgccagggctgcgtcctaaccggcgtcttggtcatagcccacgagtgcggccaccacgccttcagcgactac

SEQ ID NO: 157 - DNA, 422 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaacctcaaacgcgtcccctgcgagacaccacccttcactctcggagacctcaagaaagcaatcccacctcactgcttaaaacgctccatccctcgctccttctcctacctcctcttcgacatcctcgtctcctcctccctctaccacctctccacagcctacttccctctcctcccccaccctccccctacccagcccagcttggagcgaacgacctacaccgaactgagatacctacagcgtgagcaaggagaaagcgccgcgctatggcccctctacggggcctgccaaggctgcgtcctaacgggcctcagggtcatcgcccacgaatgcggccaccacgccttcagcgactac

SEQ ID NO: 158 - DNA, 350 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 159 - DNA, 270 bp, Artificial
  Mutation in BnaC.FAD2.b introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatagcctcctgcttctactacgtcgccaccacttacttccctctcctccctcaccctctctcctacttcacgccttcagcgactac

SEQ ID NO: 160 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctactgggcctgccaaggctgcgtcctaacgggcctctgggtcatcgcccacgaatgcggccaccacgccttcagcgactac

SEQ ID NO: 161 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctcccttacccctggcccctctactgggcctgccaaggctgcgtcctaacgggcctctgggtcatagcccacgagtgcggccaccacgccttcagcgactac

SEQ ID NO: 162 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctgacctggcccctctactgggcctgccaaggctgcgtcctaacgggcctctgggtcatcgcccacgaatgcggccaccacgccttcagcgactac

SEQ ID NO: 163 - DNA, 348 bp, Artificial
  Mutation in BnaC.FAD2.b introduced by TALE nuclease pair BnFAD2_T01
caggatccatgggtgcaggtggaagaatgcaagtgtctcctcccaccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagccgacttccctctcctcccccaccctctccctaccctagcccctctactggacctgcctaggctgcgtcctaacgggcctctggggcatctcccacatgtgcggccaccgcgccatcagcgactac

SEQ ID NO: 164 - DNA, 390 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttgctggcggtggcaagcacctgctggggggtcaagccgtgggcggcctctctactgggcctgccaagggtgcgtcctaaccggcgtcggggtcatagcccacgagtgcggccaccacgccttcagcgactac

SEQ ID NO: 165 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 166 - DNA, 421 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcaagcaggcgctggagacgggccagcggctgttgccggcgctgtgccagccccatggcttgacccccctggcccctctactgggcctgccaagggtgcgtcctaacgggcgtctgggtcatcgcccacgaatgcggccaccacgccttcagcgactac

SEQ ID NO: 167 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcctctcctcctccctctaccacctctccacagcctacttccctctcctcccccaccctctcccttcccttggcccctctactgggcctgccaaggctgcgtcctaaccggcgtctgggtcatagcccacgagtgcggccaccacgccttcagcgactac

SEQ ID NO: 168 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctcccccaccctctctcctacttgggcctctctactgggcctgccaagggtgcgtcctaaccggcgtctgggtcatagcccacgattgcggccaccacgccttcagcgactac

SEQ ID NO: 169 - DNA, 336 bp, Artificial
  Mutation in BnaC.FAD2.b introduced by TALE nuclease pair BnFAD2_T01
caggatccatgggtgcaggtggaagaatgcaagtgtgtcctccctccaagaaggctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttccctgggcctgccaaggctgcttcctaacgggcctctgggtcatctcccacgaatgcggccaccacgccttcagctactac

SEQ ID NO: 170 - DNA, 349 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 171 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcgaagacctcaagaaagcaatcccacctcactgcttcaaacgctccatcccacgctccttctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 172 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctctactgggcctgccaaggctgcgtcctaacgggcctctgggtcatcgcccacgaatgcggccaccacgccttcagcgactac

SEQ ID NO: 173 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctactgggcctgccaaggctgcgtcctaacgggcctctgggtcatagcccacgagtgcggccaccacgccttcagcgactac

SEQ ID NO: 174 - DNA, 348 bp, Artificial
  Mutation in BnaC.FAD2.b introduced by TALE nuclease pair BnFAD2_T01
caggatccatgggtgcaggtggaagaatgcaagtctctcctcccaccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttggcctctctactgggcctgccagggctgcgtcctaaccggcgtctgggtcatagcccacgagtgcggccaccacgccttcagcgactac

SEQ ID NO: 175 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctccttccccaccctctcccttacctctggcccctctactgggcctgccaaggctgcgtcctaacgggcctctgggtcatcgcccacgaatgcggccaccacgccttcagcgactac

SEQ ID NO: 176 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctctggcctctctactgggcctgccagggctgcgtcctaaccggcgtctgggtcatagcccacgagtgcggccaccacgccttcagcgactac

SEQ ID NO: 177 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctcccttaccccctctactgggcctgccaaggctgcgtcctaacgggcctctgggtcatcgcccacgaatgcggccaccacgccttcagcgactac

SEQ ID NO: 178 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcccctctactgggcctgccaaggctgcgtcctaacgggcctctgggtcatcgcccacgaatgcggccaccacgccttcagcgactac

SEQ ID NO: 179 - DNA, 355 bp, Artificial
  Mutation in BnaC.FAD2.b introduced by TALE nuclease pair BnFAD2_T01
caggatccatgggtgcaggtggaagaatgcaagtgcctcctccctccaagaagtctgaaaccgacaacatcaagcgcgtaccctgcgagacaccgcccttcactgtcggagaactcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgccctggcccctctactgggcctgccaaggctgcgtcctaacgggcctctgggtcatcgcccacgaatgcggccaccacgccttcagcgactac

SEQ ID NO: 180 - DNA, 346 bp, Artificial
  Mutation in BnaC.FAD2.b introduced by TALE nuclease pair BnFAD2_T01
caggatccatgggtgcaggtgaaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttatggcccctctacggggcctgccaaggctgcgtcctaacgggcctctgggtcatctcccacgaatgcggccaccacgccttcagcgactac

SEQ ID NO: 181 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctctgagacctcaagaaagcaatcccacctcactgcttcaaacgctccatcccacgctccttctcctcttcgacatcatcatctcctcctccctctaccacctctccacagcctacttccctctcctccccccccctcccccttacctctggcccctctactgggcctgccaaggctgcgtcctaacgggcctctgggtcatcgcccacgaatgcggccaccacgccttcagcgactac

SEQ ID NO: 182 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctactgggcctgccaagggtgcgtcctaaccggcgtctgggtcatagcccacgagtgcggccaccacgccttcagcgactac

SEQ ID NO: 183 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgtcatcctcgtctcctcctccctctaccacctctccacagcctacttccctctcctcccccaccctctctcctacttgcctctctactgggcctgccaagggtgcgtcctaaccggcgtctgggtcatagcccacgagtgcggccaccacgccttcagcgactac

SEQ ID NO: 184 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttcccttggcccctctactgggcctgccaaggctgcgtcctaacgggcctctgggtcatcgcccacgagtgcggccaccacgccttcagcgactac

SEQ ID NO: 185 - DNA, 334 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcatcgtctcctcctccctctaccacctctccacagcctacttccctctcctccctcaccctctctctactgggcctgccagggctgcgtcctaaccggcgtctgggtcatagcccacgagtgcggccaccacgccttcagcgactac

SEQ ID NO: 186 - DNA, 352 bp, Artificial
  Mutation in BnaC.FAD2.b introduced by TALE nuclease pair BnFAD2_T01
caggatccatgggtgcaggtggaagaatgcaagtgtctcctccctccaaaaagtctgaacccgacaacatcaagcgcgtaccctgcgagacaccgcccttcactgtcggagaactcaagaaagcaatcccacctcactgtttcaaacgctccatccctcgctccttctcctacctcctcttcgacatcctcgtctcctcctccctctaccacctctccacagcctacttccctctcctcccccaccctctcccttacctcgctgacccctctactgggcctgccagggctgcgtcctaaccggcgtctgggtcatatccgacgagtgcggccaccgcgccatcagcgactac

SEQ ID NO: 187 - DNA, 348 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctggcccctctactgggcctgccaaggctgcgtcctaacgggcctctgggtcatcgcccacgaatgcggccaccacgccttcagcgactac

SEQ ID NO: 188 - DNA, 419 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttagccgtagttaggcccccacttcaagaactctgtagcaccgcctacatacctcgctctgctaatcctgttacctggcccctctactgggcctgccaaggctgcgtcctaaccggcgtctgggtcatagcccacgagtgcggccaccacgccttcagcgactac

SEQ ID NO: 189 - DNA, 426 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttatggacgccaactacctctgatagttgagtcgatacttcggcgatcaccgcttccctcataatgtttaactttgttttggcctctctactgggcctgccagggctgcgtcctaaccggcgtctgggtcatagcccacgagtgcggccaccacgccttcagcgactac

SEQ ID NO: 190 - DNA, 350 bp, Artificial
  Mutation in BnaC.FAD2.b introduced by TALE nuclease pair BnFAD2_T01
caggatccatgggtgcaggaggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 191 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctctggcccctctactgggcctgccaaggctgcgtcctaacgggcctctgggtcatcgcccacgaatgcggccaccacgccttcagcgactac

SEQ ID NO: 192 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcccctctactgggcctgccaaggctgcgtcctaacgggcctctgggtcatcgcccacgaatgcggccaccacgccttcagcgactac

SEQ ID NO: 193 - DNA, 341 bp, Artificial
  Mutation in BnaC.FAD2.b introduced by TALE nuclease pair BnFAD2_T01
caggatccatgggcgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccccctcccgtacctctactgggcctgccaaggctgcgtcctaacgggcctctgggtcatagcccacgagtgcggccaccacgccttcagcgactac

SEQ ID NO: 194 - DNA, 339 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctcccccaccctctcccttacctcccctctactgggcctgccaaggctgcgtcctaacgggcctctgggtcatcgcccacgaatgcggccaccacgccttcagcgactac

SEQ ID NO: 195 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagccacgatggcggcaagcaggcgctggagcctggcccctctactgggcctgccaaggctgcgtcctaacgggcctctgggtcatcgcccacgaatgcggccaccacgccttcagcgactac

SEQ ID NO: 196 - DNA, 342 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagccacgatggcggcaagcaggcgctggagcctggcccctctactgggcctgccaaggctgcgtcctaacgggcctctgggtcatcgcccacgaatgcggccaccacgccttcagcgactac

SEQ ID NO: 197 - DNA, 346 bp, Artificial
  Mutation in BnaC.FAD2.b introduced by TALE nuclease pair BnFAD2_T01
caggatccatgggtgcaggtggaagaatgcaagtctatcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcccctctactgggcctgccaaggctgcgtcctagcgggcctcggggtcatcacccaccagtgcggccacctcgccttcatcccctac

SEQ ID NO: 198 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccccctctactgggcctgccaaggctgcgtcctaacgggcctctgggtcatcgcccacgaatgcggccaccacgccttcagcgactac

SEQ ID NO: 199 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccccgccggcccctctactgggcctgccaaggctgcgtcctaacgggcctctgggtcatcgcccacgaatgcggccaccacgccttcagcgactac

SEQ ID NO: 200 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccgcagtctacttccctctcctcccccaccctctcccttacctcgccctggcccctctactgggcctgccaaggctgcgtcctaacgggcctctgggtcatcgcccacgaatgcggccaccacgccttcagcgactac

SEQ ID NO: 201 - DNA, 355 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcgcctggcccctctactgggcctgccaaggctgcgtcctaacgggcctctgggtcatcgcccacgaatgcggccaccacgccttcagcgactac

SEQ ID NO: 202 - DNA, 334 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctctactgggcctgccaaggctgcgtcctaacgggcctctgggtcatagcccacgagtgcggccaccacgccttcagcgactac

SEQ ID NO: 203 - DNA, 342 bp, Artificial
  Mutation in BnaC.FAD2.b introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagccacgatggcggcaagcaggcgctggagcctggcccctctactgggcctgccaaggctgcgtcctaacgggcctctgggtcatcgcccacgaatgcggccaccacgccttcagcgactac

SEQ ID NO: 204 - DNA, 338 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcctcccccaccctctccccctctactgggcctgccaaggctgcgtcctaacgggcctctgggtcatcgcccacgaatgcggccaccacgccttcagcgactac

SEQ ID NO: 205 - DNA, 401 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttaccttgcctcgggcatccaagcagcaagcgcgttacgccgtgggtcgatgtttgactggcccctctactgggcctgccaaggctgcgtcctaacgggcctctgggtcatcgcccacgaatgcggccaccacgccttcagcgactac

SEQ ID NO: 206 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtccactgcgagacaccacccttcactctcggagacctcaagaaagcaatcccaccgcactgtttcaaacgctcgatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 207 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccgctggcccctctactgggcctgccaaggctgcgtcctaacgggcctctgggtcatcgcccacgaatgcggccaccacgccttcatcgactac

SEQ ID NO: 208 - DNA, 348 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatagcccacgagtgcggccaccacgccatcagcgactac

SEQ ID NO: 209 - DNA, 349 bp, Artificial
  Mutation in BnaC.FAD2.b introduced by TALE nuclease pair BnFAD2_T01
caggatccatgggtgcaggtggaagaatgcaagtccctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctggcccctctactgggcctgccaaggctgcgtcctaacgggcctctgggtcatcgcccacgaatgcggccaccacgccatcagcgactac

SEQ ID NO: 210 - DNA, 373 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctccccccccctctcccttacctctccagcgcctgcttgccgccaccgtgcccctctactgggcctgccaaggctgcgtcctaacgggcctctgggtcatcgcccacgaatgcggccaccacgccttcagcgactac

SEQ ID NO: 211 - DNA, 312 bp, Artificial
  Mutation in BnaC.FAD2.b introduced by TALE nuclease pair BnFAD2_T01
caggatccatgggtgcaggtggaagaatgcaagtgtctcctccctcccagaagtctgaaaccgacaccatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctgggtctgccaaggctgcgtcctaacgggcctcggggtcatcgcccacgaatgcggccaccacgccttcagcgactac

SEQ ID NO: 212 - DNA, 314 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctcaccctctctcctacttctggcctctctactgggcctgccagggctgcgtcctaacgggcctctgggtcatagcccacgagtgcggccaccacgccttcagcgactac

SEQ ID NO: 213 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctccccccccctctcccttaccccctctactgggcctgccacggctgcgtcctaacgtgcctctgggtcatcgcccccgaatgcggccaccacgccttcagcgactac

SEQ ID NO: 214 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcatccctctaccacctctccacagcctacttccctctcctcccccaccctctcccttaccttggcccctctactgggcctgccaagggtgcgtcctaacgggcctctgggtcatagcccacgagtgcggccaccacgccttcagcgactac

SEQ ID NO: 215 - DNA, 336 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctgggcctgccaaggctgcgtcctaacgggcctctgggtcatcgcccacgaatgcggccaccacgccttcagcgactac

SEQ ID NO: 216 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctaccccaccctctcccttacctcccctctactgggccggccaaggctgcgtcctaacgggcctctgggtcatcgcccacgaatgcggccaccacgccttcagcgactac

SEQ ID NO: 217 - DNA, 372 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctccagcggctgttgccgccatcgtgcccctctactgggcctgccaaggctgcgtcctaacgggcctctgggtcatcgcccacgaatgcggccaccacgccttcagcgactac

SEQ ID NO: 218 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccaccctctcccttacccctggcccctctactgggcctgccaaggctgcgtcctaacgggcctctgggtcatcgcccacgaatgcggccaccacgccttcagcgactac

SEQ ID NO: 219 - DNA, 350 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 220 - DNA, 374 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctccctctaccacctctccacagcctacttccctctcctcccccaccctctcccttacctcgctcgccgcagccgaacgaccgagcgcagcgtggcccctctactgggcctgccaaggctgcgtcctaacgggcctctgggtcatagcccacgagtgcggccaccacgccttcagcgactac

SEQ ID NO: 221 - DNA, 468 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttgaggggtcaagccgtgggcctggcacagcaccggcaacagcgccttaaacttttgtatacaaagttgttgcatgcaggcctcggcaggggcaagcacctgggcggctccaggaagccctggcccctctactgggcctgccaaggctgcgtcctaacgggcctctgggtcatcgcccacgaatgcggccaccacgccttcagcgactac

SEQ ID NO: 222 - DNA, 412 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgctggagacggtccagcggctgttgccggtgctgtgccaggcccacggcttgaccccggagctggcccctctactgggcctgccaaggctgcgtcctaacgggcctctgggtcatcgcccacgaatgcggccaccacgccttcagcgactac

SEQ ID NO: 223 - DNA, 326 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccccctctactgggcctgccaagggtgcgtcctaaccggcgtctgggtcatagcccacgagtgcggccaccacgccttcagcgactac

SEQ ID NO: 224 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccccccctggcccctctactgggcctgccaaggctgcgtcctaacgggcctctgggtcatagcccacgagtgcggccaccacgccttcagcgactac

SEQ ID NO: 225 - DNA, 347 bp, Artificial
  Mutation in BnaC.FAD2.b introduced by TALE nuclease pair BnFAD2_T01
caggatccatgggtgcaggcggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctcacctgcccctctactgggcctgccgaggctgcatcctaacgggcctctgggtcatagcccacgagtgcggccaccacgccttcagcgactac

SEQ ID NO: 226 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttggcctctctactgggcctgccaagggtgcgtgctagccggcgtcggggtcatagcccacgagtgcggccaccacgccttcagcgactac

SEQ ID NO: 227 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctcccgggccagccaaggctgcgtcctaacgggcctctgggtcatcgcccacgaatgcggccaccacgccatcagcgactac

SEQ ID NO: 228 - DNA, 352 bp, Artificial
  Mutation in BnaC.FAD2.b introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccccgcctggccctctactgggcctgccaaggctgcgtcctaacgggcctctgggtcatcgcccacgaatgcggccaccacgccttcagcgactac

SEQ ID NO: 229 - DNA, 343 bp, Artificial
  Mutation in BnaC.FAD2.b introduced by TALE nuclease pair BnFAD2_T01
caggatccaggggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttccccctctactgggcctgccaaggctgcgtcctaacgggcctctgggtcatagcccacgagtgcggccaccacgccttcagcgactac

SEQ ID NO: 230 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccccctggcccctctactgggcctgccaaggctgcgtcctaacgggcctctgggtcatagcccacgagtgcggccaccacgccttcagcgactac

SEQ ID NO: 231 - DNA, 349 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaaccccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaaccggcgtctgggtcatagcccacgagtgcggccaccacgccttcagcgactac

SEQ ID NO: 232 - DNA, 335 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcccttacctctggcccctctactgggcctgccaaggctgcgtcctaacgggcctcggggtcatagcccacgagtgcggccaccacgccctcagcgactac

SEQ ID NO: 233 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttacctcgccacctggcacctctactgggcctgccaaagctgcgtcctaacgggcctctgggtcatcgcccacgaatgcggccaccacccttcagcgactac

SEQ ID NO: 234 - DNA, 340 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccacccgcctggcccctctactgggcctgccaaggctgcgtcctaaccggcgtctgggtcatagcccacgagtgcggccaccacgccttcagcgactac

SEQ ID NO: 235 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcagagacctcaagaaagcaatcccacctcactgcttcaaacgctccatccctcgctccttctcctacctcctcttcgacatcctcgtctcctcctccctctaccacctctccacagcctacttccctctcctcccccaccctcgcccttcccactggcccctctactgggccggccaaggctgcgtcctaacgggcctctgggtcatcgcccacgaatgcggccaccacgccttgagcgactac

SEQ ID NO: 236 - DNA, 350 bp, Artificial
  Mutation in BnaC.FAD2.b introduced by TALE nuclease pair BnFAD2_T01
caggatccatgggtgcaggtggaagaatgcaagtctatccaccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttcccttggcccctctactgggcctgccaaggctgcgtcctaacgggcctctgggtcatcgcccaccaatgcggccaccacgccttcatcgactac

SEQ ID NO: 237 - DNA, 422 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgttgccggtgctgtgccaggcctacggcttgaccccggagcaggtggtggccatcgccagcaatattggtgctggcccctctactgggcctgccaaggctgcgtcctaacgggcctctgggtcatcgcccacgaatgcggccaccacgccttcagcgactac

SEQ ID NO: 238 - DNA, 412 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccccgctggagacggtccagcggctgtggccggtgctgtgccaggcccacggcttgaccccggagctggtccctctactgggcctgccaaggctgcgtcctaacgggcctctgggtcatcgcccacgaatgcggccaccacgccttcagcgactac

SEQ ID NO: 239 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 240 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttatggcccctctactgggcctgccaaggctgcgtcctaacgggcctctgggtcatagcccacgagtgcggccaccacgccttcagcgactac

SEQ ID NO: 241 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcttaacgggcctctgggtcatcgcccacgaatgcggccaccacgccttcagcgactac

SEQ ID NO: 242 - DNA, 350 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacccctggcccctctactgggcctgccaaggctgcgtcctaacgggcctctgggtcatagcccacgagtgcggccaccacgccttcagcgactac

SEQ ID NO: 243 - DNA, 261 bp, Artificial
  Mutation in BnaC.FAD2.b introduced by TALE nuclease pair BnFAD2_T01
caggatccatgggtgcaggtggaagaatgctagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttaccacgccttcagcgactac

SEQ ID NO: 244 - DNA, 350 bp, Artificial
  Mutation in BnaC.FAD2.b introduced by TALE nuclease pair BnFAD2_T01
caggatccatgggtgcaggtggaagaatgcaagtctctcctccctccagctccctcggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 245 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttgccgctggcccctctactgggcctgccaaggctgcgtcctaacgggcctctgggtcatcgcccacaaatgcggccaccacgccttcagcgactgc

SEQ ID NO: 246 - DNA, 346 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatcccacgctccttctcctacctcctcttcgacatcctcgtctcctcctccctctaccacctctccacagcctacttccctctcctcccccaccctctcccttacctgccctctactgggcctgccaaggctgcgtcctaaccggcgtctgggtcatcgcccacgaatgcggccaccacgccttcaacgactac

SEQ ID NO: 247 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgagtgcggccaccacgccttcagcgactac

SEQ ID NO: 248 - DNA, 390 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctccctcctcttcgacttcctcgcctcctcctccctctaccccccctccacatcctacttccctctcctccctcaccctctcccccacaggctgcctgcgtcacgcccctgctggggggccaagccgcgcccggcccctctactgggcctgccaagggtgcgtcctaacgggcctctgggtcatagcccacgagtgcggccaccacgccttcagcgactac

SEQ ID NO: 249 - DNA, 351 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctactactggcctctctactgggcctgccaagggtgcgtcctaaccggcgtctgggtcatagcccacgagtgcggccaccacgccttcagcgactac

SEQ ID NO: 250 - DNA, 358 bp, Artificial
  Mutation in BnaC.FAD2.b introduced by TALE nuclease pair BnFAD2_T01
caggatccatgggtgcaggtggaagaatgcaagtctcacatacctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctcgtctggcccctctactgggcctgccaaggctgcgtcctaacgggcctctgggtcatagcccacaagtgctgccaccacgccttcagcgactac

SEQ ID NO: 251 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctcccccttacctctactgggcctgccaaggctgcgtcctaacgggcctctgggtcatcgcccacgaatgcggccaccacgccttcagcgactac

SEQ ID NO: 252 - DNA, 334 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctccctctaccacctctccacagcctacttccctctcctcccccaccctctcccttacctctactgggcctgccaaggctgcgtcctaacgggcgtctaggtcatagcccacgagtgcggccaccacgccttcagcgactac

SEQ ID NO: 253 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctcgcctacttctctactgggcctgccagggctgcgtcctaacgggcctctgggtcatcgcccacgaatgcggccaccacgccttcagcgactac

SEQ ID NO: 254 - DNA, 261 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccatcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttaccacgccttcagcgactac

SEQ ID NO: 255 - DNA, 356 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccccccccctctcccttacctccttcctggcccctctactgggcctgccaaggctgcgtcctaacgggcctctgggtcatcgcccacgaatgcggccaccacgccttcagcgactac

SEQ ID NO: 256 - DNA, 394 bp, Artificial
  Mutation in BnaC.FAD2.b introduced by TALE nuclease pair BnFAD2_T01
caggatccatgggtgcaggtggaagaatgcaagtctctcctccctcccgctcccccggaaccaacaccctaaaacgcgtcccctgcgagacaccaccattcactctcggagacctcaagaaagcaatcccacctcactgcttcaaacgctccatccctcgctccttctcctacctcctcttcgacatactcgtctccccctccctctaccacctctccacagcctacttccctctcctccccccccctctcccttacctctaagggcgagatccggtgcagattacttgtgttgagagtgaagatagcccctctactcggcctgccaaggctgcgtcctaacgggcctctgggtcatcgccctccaatgctgccaccacgccttcagcgactac

SEQ ID NO: 257 - DNA, 350 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgcttcaaacgctccatccctcgctccttctcctacctcctcttcgacatcctcgtctcctcctccctctaccacctctccacagcctacttccctctcctcccccaccctctcccttccccctggcccctctactgggcctgccaaggctgcgtcctaacgggcctctgggtcatcgcccacgaatgcggccaccacgccttcagcgactac

SEQ ID NO: 258 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctgacccctctactgggcctgccaaggctgcgtcctaacgggcctctgggtcatcgcccacgaatgcggccaccacgccttcagcgactac

SEQ ID NO: 259 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 260 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctactgggcctgccaaggctgcgtcctaacgggcctctgggtcatcgcccacgaatgcggccaccacgccttcagcgactac

SEQ ID NO: 261 - DNA, 343 bp, Artificial
  Mutation in BnaC.FAD2.b introduced by TALE nuclease pair BnFAD2_T01
caggatccatgggtgcaggtggaagaatgcaagtctgaccccccatcagctcccccgaaaccaaaaccctcaaccgcgtcccctgcgagccaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacccctctactgggcctgccaaggctgcttcctaacgggcctgggggtcatcgcctgccaatgcggccaccacgccttgagcgactac

SEQ ID NO: 262 - DNA, 312 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctgtgcgtcctaaccggcgtctgggtcatagcccacgagtgcggccaccacgccttcagcgactac

SEQ ID NO: 263 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctactgggcctgccaaggctgcgtcctaacgggcctctgggtcatagcccacgagtgcggccaccacgccttcagcgactac

SEQ ID NO: 264 - DNA, 345 bp, Artificial
  Mutation in BnaC.FAD2.b introduced by TALE nuclease pair BnFAD2_T01
caggatccatgggtgcaggtggaagaatgcaagtctatcctccctcccgctcccccggaaccaacaccatcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccccccccctctcccttggcccctctactgggcctgccaaggctgcgtcctaacgggcctcggggtcatagcccacaagtgcggccaccacgccttcatcgactac

SEQ ID NO: 265 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttggcccctctactgggcctgccaaggctgcgtcctaacgggcctctgggtcatagcccacgaatgcggccaccacgccttcagcgactac

SEQ ID NO: 266 - DNA, 333 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctactgggcctgccaaggctgcgtcctaacgggcctctgggtcatagcccacgagtgcggccaccacgccttcagcgactac

SEQ ID NO: 267 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgagtgcggccaccacgccttcagcgactac

SEQ ID NO: 268 - DNA, 331 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctggcccctctactgggcctgccaaggctgcgtcctaacgggcgtctgggtcatagcccacgagtgcggccaccacgccttcagcgactac

SEQ ID NO: 269 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccagggctgcgtcctaaccggcgtctgggtcatagcccacgagtgcggccaccacgccttcagcgactac

SEQ ID NO: 270 - DNA, 429 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcaatctcggagacctcaagaaagaaatcccacctcactgcttcaaacgctccatccctcgctccttctcctacctcctcttcgacatcctcgtctcctcctccctctaccacctctccacagcctacttccctctcctccccccccctctcccgtacctctacagcggcggttgcgggtgctgtgccaggccaacggcgtgaccccggagcaggtggtggccatcgccagccacgagggtggcccctctactgggcctgccaaggctgcgtcctaacgggcctctgggtcatcgcccacgaatgcggccaccacgccttcagcgactac

SEQ ID NO: 271 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcccctctactgggcctgccaaggctgcgtcctaaccggcgtctgggtcatagcccacgagtgcggccaccacgccttcagcgactac

SEQ ID NO: 272 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttacctctcctcccccaccctctcccttggcccctctactgggcctgccaaggctgcgtcctaacgggcctctgggtcatcgcccacgaatgcggccaccacgccttcagcgactac

SEQ ID NO: 273 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcaggcctctctactgggcctgccaagggtgcgtcctaaccggcgtctgggtcatagcccacgagtgcggccaccacgccttcagcgactac

SEQ ID NO: 274 - DNA, 354 bp, Artificial
  Mutation in BnaC.FAD2.b introduced by TALE nuclease pair BnFAD2_T01
caggatccatgggtgcaggtggaagaatgcaagtctctcctccctcaagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttacctctcctcccccaccctctgccttacctcgccctggcccctctactgggcctgccaaggctgctgccgaacgggcctcggggtcatcgcccacgaatgcggccaccacgccatcagcgactac

SEQ ID NO: 275 - DNA, 338 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccccctctactgggcctgccaaggctgcgtcctaacgggcctctgggtcatcgcccacgaatgcggccaccacgccttcagcgactac

SEQ ID NO: 276 - DNA, 343 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacccctctactgggcctgccaaggctgcgtcctaacgggcctctgggtcatcgcccacgagtgcggccaccacgccttcagcgactac

SEQ ID NO: 277 - DNA, 350 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttaccttggcccctctactgggcctgccaaggctgcgtcctaacgggcctctgggtcatcgcccacgaatgcgtccaccacgccttcagcgactac

SEQ ID NO: 278 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaagggtgcgtcctaaccggcgtctgggtcatagcccacgagtgcggccaccacgccttcagcgactac

SEQ ID NO: 279 - DNA, 422 bp, Artificial
  Mutation in BnaC.FAD2.b introduced by TALE nuclease pair BnFAD2_T01
caggatccatgggtgcaggtggaagaatgcaagtctatcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccccccccctctcccttccctctggcaagcaggcgctggagacggtccagcggctgttgccggtgctgtgccaggcccacggcttgacccccctggcccctctactgggcctgccaaggctgcgtcctaacgggcctctgggtcatcgcccacgaatgcggccaccacgccttcagcgactac

SEQ ID NO: 280 - DNA, 340 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccacccgcctggcccctctactgggcctgccaagactgcgtcctaacgggcctctgggtcatagcccacgagtgcggccaccacgccttcagcgactac

SEQ ID NO: 281 - DNA, 332 bp, Artificial
  Mutation in BnaC.FAD2.b introduced by TALE nuclease pair BnFAD2_T01
caggatccatgggtgcaggtggcagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctggcccctctacggggcctgccaaggctgcgtcctaacgggcctctgggtcatcgcccacgagtgcggccaccacgccttcagcgactac

SEQ ID NO: 282 - DNA, 373 bp, Artificial
  Mutation in BnaC.FAD2.b introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctctccagcgcctgcttgccgccatcgtgcccctctactgggcctgccaaggctgcgtcctaacgggcctctgggtcatcgcccacgaatgcggccaccacgccttcagcgactac

SEQ ID NO: 283 - DNA, 349 bp, Artificial
  Mutation in BnaC.FAD2.b introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccacctcactgcttcaaacgctccatcccacgctccttctcctcttcgacatcctcgtctcctcctccctctaccacctctccacagcctacttccctctcctcccccaccctctcccttacctcgccgcctggcctctctactgggcctgccaagggtgcgtcctaaccggcgtctgggtcatagcccacgaatgcggccaccacgccttcagcgactac

SEQ ID NO: 284 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccctggcccctctactgggcctgccaaggctgcgtcctaacgggcctctgggtcatagcccacgagtgcggccaccacgccttcagcgactac

SEQ ID NO: 285 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgccctggcccctctactgggcctgccaaggctgcgtcctaacgggcctctgggtcatcgcccacgagtgcggccaccacgccttcagcgactac

SEQ ID NO: 286 - DNA, 349 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccacccttcactctcggagacctcaagaaagcaatcccacctcactgcttcaaacgctccatccatcgctccttctcctacctcctcttcgacatcctcgtctcctcctccctctaccacctctccacagcctacttccctctcctccctcaccctctctcctttcctggcctctctactgggcctgccagggctgcgtcctaaccggcgtctgggtcatagcccacgagtgcggccaccacgccttcagcgactac

SEQ ID NO: 287 - DNA, 372 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctccagcggctgttgccgccatcgtgcccctctactgggcctgccaaggctgcgtcctaacgggcctctgggtcatcgcccacgaatgcggccaccacgccttcagcgactac

SEQ ID NO: 288 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccctcccctggcccctctactgggcctgccaaggctgcgtcctaacgggcgtctgggtcatagcccacgagtgcggccaccacgccttcagcgactac

SEQ ID NO: 289 - DNA, 311 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctcaccctctctcctacttggcctctctactgggcctgccagggctgcgtcctaaccggcgtctgggtcatagcccacgagtgcggccaccacgccttcagcgactac

SEQ ID NO: 290 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaaaaccctcaaacgcgtcccctgcgagacaccacccttcactctcggagacctcaagaaagcaatcccacctcactgcttcaaacgctccatcccacgctccttctcctcttcgacatcatcatctcctcctccctctaccacctctccacagcctacttccctctcctcccccaccctctcccttacctctggcccctctactaggcctgccaaggctgcgtcctaacgggcctctgggtcatcgcccacgaatgcggccaccacgccttcagcgactac

SEQ ID NO: 291 - DNA, 358 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctcgtctggcccctctactgggcctgccaaggctgcggcctaacgggcctctgggtcatcgcccacgaatgcggccaccacgccttcagcgactac

SEQ ID NO: 292 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgtcgtggcccctctactgggcctaccaaggctgcgtcctaacgggcctctgggtcatcgcccacgaatgcggccaccacgccttcagcgactac

SEQ ID NO: 293 - DNA, 351 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacccctggcccctctactgggcctgccaaggctgcgtcctaacgggcctctgggtcatcgcccacgaatgcggccaccacgccttcagcgactac

SEQ ID NO: 294 - DNA, 351 bp, Artificial
  Mutation in BnaC.FAD2.b introduced by TALE nuclease pair BnFAD2_T01
caggatccatgggtgcaggtggaagaatgcaagtgtctcctccctccaaaagtctgaaaccgacaacatcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggccctctactgggcctgccaaggctgcgtcctaacgggcctctgggtcatcgcccacgaatgcggccaccacgccttcagcgactac

SEQ ID NO: 295 - DNA, 335 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctctactgggcctgccaagggtgcgtcctaaccggcgtctgggtcatagcccacgagtgcggccaccacgccttcagcgactac

SEQ ID NO: 296 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctggcccctctactgggcctgccaaggctgcgtcctaacgggcctctgggtcatagcccacgagtgcggccaccacgccttcagcgactac

SEQ ID NO: 297 - DNA, 342 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccaccattcactctcggagacctcaagaaagcaatcccacctcactgcttcaaacgccccatcccacgctccttctcctcttcgacatcctcgtctcctcctccctctaccacctctccacagcctacttccctctcctcccccaccctctcccttaccttggcctctctactgggcctgccagggctgcgtcctaaccggcgtctgggtcatagcccacgagtgcggccaccacgccttcagcgactac

SEQ ID NO: 298 - DNA, 338 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttacctcgcctgaccctctactgggcctgccaaggctgcgtcctaacgggcctctgggtcatagcccacgagtgcggccaccacgccttcagcgactac

SEQ ID NO: 299 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctggcccctctactgggcctgccaaggctgcgtcctaacgggcctctgggtcatcgcccacgaatgcggccaccacgccttcagcgactac

SEQ ID NO: 300 - DNA, 307 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcatcctcggctcctccctcaccctctctcctacctctctactgggcctgccaagggtgcgtcctaaccggcgtctgggtcatagcccacgagtgcggccaccacgccttcagcgactac

SEQ ID NO: 301 - DNA, 339 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctctctactgggcctgccagggctgcgtcctaacgggcctctgggtcatagcccacgagtgcggccaccacgccttcagcgactac

SEQ ID NO: 302 - DNA, 331 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccctggcccctctactgggcctgccaaggctgcgtcctaacgggcctctgggtcatcgcccacgaatgcggccaccacgccttcagcgactac

SEQ ID NO: 303 - DNA, 342 bp, Artificial
  Mutation in BnaC.FAD2.b introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagccacgatggcggcaagcaggcgctggagcctggcccctctactgggcctgccaaggctgcgtcctaacgggcctctgggtcatcgcccacgaatgcggccaccacgccttcagcgactac

SEQ ID NO: 304 - DNA, 373 bp, Artificial
  Mutation in BnaC.FAD2.b introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctctccagcgcctgcttgccgccatcgtgcccctctactgggcctgccaaggctgcgtcctaacgggcctctgggtcatagcccacgagtgcggccaccacgccttcagcgactac

SEQ ID NO: 305 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctccgcctggcccctctactgggcctgccaaggctgcgtcctaacgggcctctgggtcatcgcccacgaatgcggccaccacgccttcagcgactac

SEQ ID NO: 306 - DNA, 332 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctactgggcctgccaaggctgcgtcctaacgggcctctgggtcatagcccacgagtgcggccaccacgccttcagcgactac

SEQ ID NO: 307 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcccctctactgggcctgccaaggctgcgtcctaacgggcctctgggtcatcgcccacgaatgcggccaccacgccttcagcgactac

SEQ ID NO: 308 - DNA, 339 bp, Artificial
  Mutation in BnaC.FAD2.b introduced by TALE nuclease pair BnFAD2_T01
caggatccatgggtgcaggtggaagaatgcaagtctctactccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctccccctctactgggcctgccaaggctgcgtcctaacgggcctctgggtcatcgcccacgaatgcggccaccacgccttcagcgactac

SEQ ID NO: 309 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcggcccctctactgggcctgccaaggctgcgtcctaacgggcctctgggtcatcgcccacgaatgcggccaccacgccttcagcgactac

SEQ ID NO: 310 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 311 - DNA, 348 bp, Artificial
  Mutation in BnaC.FAD2.b introduced by TALE nuclease pair BnFAD2_T01
caggatccatgggtgcaggtagaagaatgcaagtctctcctccctcccgctcccccgaaaccaaaaccctcaaacgcgtcccctgcgagacaccacccttcactctcggagacctcaagaaagcactcccacctcactgcttcaaacgctccatccctcgctccttctcctacctcctcttcgacatcctcgtctcctcctccctctgccacctctccacagcctacttccctctcctcccccaccctctcccttacctggcccctctactgggcctgccaaggctgcgtcctaacgggcctctgggtcatagcccacgagtgcggccaccacgccttcagcgactac

SEQ ID NO: 312 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctggcccctctactgggcctgccaaggctgcgtcctaacgggcctctgggtcatagcccacgagtgcggccaccacgccttcagcgactac

SEQ ID NO: 313 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatagcccacgaatgcggccaccacgccttcagcgactac

SEQ ID NO: 314 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttctggcctctctactgggcctgccagggctgcgtcctaacgggcctctgggtcatagcccacgagtgcggccaccacgccttcagcgactac

SEQ ID NO: 315 - DNA, 350 bp, Artificial
  Mutation in BnaC.FAD2.b introduced by TALE nuclease pair BnFAD2_T01
caggatccatgggtgcaggtggaagaatgcaagtctatactccctcccgctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttgcccctggcccctctactgggcctgccaaggctgcgtcctaacgggcctctgtgtcatcgcccacgaatgcggcctccacgccttcatcgactac

SEQ ID NO: 316 - DNA, 348 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 317 - DNA, 351 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccccccccctctcccttacctctggcccctctactgggcctgccaaggctgcgtcctaacgggcctctgggtcatcgcccacgaatgcggccaccacgccttcagcgactac

SEQ ID NO: 318 - DNA, 355 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgccctggtccctctactgggcctgccaaggctgcgtcctaacgggcctctgggtcatagcccacgagtgcggccaccacgccttcagcgactac

SEQ ID NO: 319 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaagcgcgtaccctgcgagacaccgcccttcactgtcggagacctcaagaaagcaatcccacctcactgcttcaaacgctccatcccacgctccttctcctcttcgacatcatcatctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 320 - DNA, 337 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatagcctcctgcttctactacgtcgccaccacttacttccctctcctccctcaccctctctcctagcctctctactgggcctgccagggctgcgtcctaaccggcgtctgggtcatagcccacgagtgcggccaccacgccttcagcgactac

SEQ ID NO: 321 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaaaaccctcaaacgcgtcccctgcgagacaccacccatcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacccctctactgggcctgccaaggctgcgtcctaacgggcctctgggtcatcgcccacgaatgcggccaccacgccttcagcgactac

SEQ ID NO: 322 - DNA, 335 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctcccccaccctcgctcctcctctctactgggcctgccaaggctgcgtcctaacgggcctctgggtcatagcccacgagtgcggccaccacgccttcagcgactac

SEQ ID NO: 323 - DNA, 354 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccctggcccctctactgggcctgccaaggctgcgtcctaacgggcctctgggtcatagcccacgagtgcggccaccacgccttcagcgactac

SEQ ID NO: 324 - DNA, 348 bp, Artificial
  Mutation in BnaC.FAD2.b introduced by TALE nuclease pair BnFAD2_T01
caggatccatggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcggcccctctactgggcctgccaaggctgcgtcctaacgggcctctgggtcatcgcccacgaatgcggccaccacgccttcagcgactac

SEQ ID NO: 325 - DNA, 333 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatagcctcctgcttctactacgtcgccaccacttacttccctctcctccctcaccctctctcctactctactgggcctgccaagggtgcgtcctaaccggcgtctgggtcatagcccacgagtgcggccaccacgccttcagcgactac

SEQ ID NO: 326 - DNA, 355 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcgcctggcccctctactgggcctgccagggctgcgtcctaacgggcctctgggtcatagcccacgagtgcggccaccacgccttcagcgactac

SEQ ID NO: 327 - DNA, 332 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatagcctcctgcttctactacgtcgccaccacttacttccctctcctccctcaccctctggcctctctactgggcctgccaagggtgcgtcctaaccggcgtctgggtcatagcccacgagtgcggccaccacgccttcagcgactac

SEQ ID NO: 328 - DNA, 305 bp, Artificial
  Mutation in BnaC.FAD2.b introduced by TALE nuclease pair BnFAD2_T01
caggatccattggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctgggtctgccaaggctgcgtcctaacgggcctctgggtcatcgcccacgagtgcggccaccacgccttcagcgactac

SEQ ID NO: 329 - DNA, 337 bp, Artificial
  Mutation in BnaC.FAD2.b introduced by TALE nuclease pair BnFAD2_T01
caggatccatgggtgcaggtggcagaatgcaagtctctcctccctccagctcccccgaaaccaaaaccctcaaacgcgtcccctgcgagacaccacccttcactctcggagacctaaagaaagcaatcccacctcactgcttcaaacgctccatccctcgctccttctcctacctcctcttcgacatcctcgtctcctcctccctctaccacctctccacagcctacttccctctcctcccccaccctcgcccctctactgggcctgccaaggctgcgtcctaacgggcctctgggtcatcgcccacgaatgcggccaccacgccttcagcgactac

SEQ ID NO: 330 - DNA, 333 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcctcgtctcctcctccctctaccacctctccacagcctacttccctctcctcccccaccctccccctccctctactgggcctgccaaggctgcgtcctaacgggcctctgggtcatcgcccacgaatgcggccaccacgccttcagcgactac

SEQ ID NO: 331 - DNA, 382 bp, Artificial
  Mutation in BnaC.FAD2.b introduced by TALE nuclease pair BnFAD2_T01
caggatccatgggtgcaggtggaagaatgcaagtctctcctccctcccgctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccgtaccgcgctcgccgcagccgaacgaccgagcgcagcgtggcccctctactgggcctgccaaggctgcgtcctaacgggcctctgggtcatcgcccacgaatgcggccaccacgcctgcagcgactac

SEQ ID NO: 332 - DNA, 351 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 333 - DNA, 336 bp, Artificial
  Mutation in BnaC.FAD2.b introduced by TALE nuclease pair BnFAD2_T01
caggatccatgggtgcaggtggaagcatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcctcatctcctcctcggctcctccctctaccacctctccacagcctacttccctctcctccctccccctccccctcccgggcctgcccgggctgcgtcccaaccggcgtttgggtccaagcccccgagtgccgcccccccgccttcagcgaattac

SEQ ID NO: 334 - DNA, 341 bp, Artificial
  Mutation in BnaC.FAD2.b introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctactgggcctgccaaggctgcgtcctaacgggcctctgggtcatcgcccacgaatgcggccaccacgccttcagcgactac

SEQ ID NO: 335 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttggcctctctactgggcctgccagggctgcgtcctaaccggcgtctgggtcatagcccacgagtgcggccaccacgccttcagcgactac

SEQ ID NO: 336 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctccctctaccacctctccacagcctacttccctctcctcccccaccctctcccttacctctggcccctctactgggcctgccaagggtgcgtcctaacgggcctctgggtcatagcccacgagtgcggccaccacgccttcagcgactac

SEQ ID NO: 337 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 338 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccctacctcccctctactgggcctgccaaggctgcgtcctaacgggcctctgggtcatcgcccacgaatgcggccaccacgccttgagcaactac

SEQ ID NO: 339 - DNA, 348 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatagcccacgagtgcggccaccacgccttcagcgactac

SEQ ID NO: 340 - DNA, 326 bp, Artificial
  Mutation in BnaC.FAD2.b introduced by TALE nuclease pair BnFAD2_T01
caggatccatgggtgcaggtggaagaatgcaagtctctactccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccctctactgggcctgccaaggctgcgtcctaacgggcctctgggtcatcgcccacgaatgcggccaccacgccttcagcgactac

SEQ ID NO: 341 - DNA, 358 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctcgtctggcccctctactgggcctgccaaggctgcgtcctaacgggcctctgggtcatcgcccacgaatgcggccaccacgccttcagcgactac

SEQ ID NO: 342 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtccactgcgagacaccacccttcactctcggagacctcaagaaagcaatcccacctcactgcttcaaacgctccatccctcgctacttctcctacctcctcttcgacatcctcgtctcctcctccctctaccacctctccacagcctacttccctctcctcccccaccctctcccttcccttggcccctctactgggcctgccaaggctgcgtcctaacgggcctctgggtcatcgcccacgaatgcggccaccacgccttcagcgactac

SEQ ID NO: 343 - DNA, 429 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccgtccccctccagcggctgttgccggtcctgtgccaggcccacggcttgcccccggagcaggtggtggccatcgccagccacgatggtggcccctctactgggcctgccaaggctgcgtcctaacgggcctctgggtcatagcccacgagtgcggccaccacgccttcagcgactac

SEQ ID NO: 344 - DNA, 355 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcacgcctggcccctcaactgggccggccaaggctgcgtcctaacgggcctctgggtcatcgcccacgaatgcggccaccacgccttcagcgactac

SEQ ID NO: 345 - DNA, 268 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggatacctcaagaaagcaatcccacctcactgcttcaaacgctccatccctcgctccttctcctacccccccttcgacatcctcgtctcctcctcggctcctccctctaccacctctccaccgcctacttccctctccctcaccacgccttcagcgactac

SEQ ID NO: 346 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctatggcctctctactgggcctgccagggctgcgtcctaaccggcgtctgggtcatagcccacgagtgcggccaccacgccttcagcgactac

SEQ ID NO: 347 - DNA, 356 bp, Artificial
  Mutation in BnaC.FAD2.b introduced by TALE nuclease pair BnFAD2_T01
caggatccatgggtgcaggtggaagaatgcaagtctctcctccatccagctcccccgaaaccaaaacactcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgccacctggcccctctactgggcctgccaaggctgcgtcctaacgggcctctgggtcatcgcccacgaatgcggccaccacgccttcagcgactac

SEQ ID NO: 348 - DNA, 343 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctccctggcccctctactgggcctgccaaggctgcgtcctaacgggcctctgggtcatagcccacgagtgcggccaccacgccttcagcgactac

SEQ ID NO: 349 - DNA, 331 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgcttcaaacgctccatccctcgctccttctcctacctcctcttcgacatcctcgtctcctcctccctctaccacctctccacagcctacttccctctcctccctggcccctctactgggcctgccaaggctgcgtcctaacgggcctctgggtcatagcccacgagtgcggccaccacgccttcagcgactac

SEQ ID NO: 350 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctcccccaccctctcccttacctcgccctggcccctctactgggcctgccaaggctgcgtcctaacgggcctctgggtcatcgcccacgaatgcggccaccacgccttcagcgactac

SEQ ID NO: 351 - DNA, 368 bp, Artificial
  Mutation in BnaC.FAD2.b introduced by TALE nuclease pair BnFAD2_T01
caggatccatgggtgcaggtggaagaatgcagtgtcttctccctccaaaaagtttgaaaccgacaacatccagcgcgtaccctgcgagacaccgcccttcactgtcggagaactcaagaaagcaatccccccgccctgcttcaaacgctcgctccctccctccttctcctacctcctcttccacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggacaccacgccttcagcgactacccacgccttcagcgactac

SEQ ID NO: 352 - DNA, 353 bp, Artificial
  Mutation in BnaC.FAD2.b introduced by TALE nuclease pair BnFAD2_T01
caggatccatgggtgcaggtggcagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttaccacgcctggccctctactgggcctgccaaggctgcgtcctaacgggcctctgggtcatcgcccacgaatgcggccaccacgccttcagcgactac

SEQ ID NO: 353 - DNA, 420 bp, Artificial
  Mutation in BnaC.FAD2.b introduced by TALE nuclease pair BnFAD2_T01
caggatccatgggtgcaggtggcagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcctcgacatcctcgtctcctcctccctctaccacctctccacagcctacttccctctcctcccccacccgcctcccccccccccgccacccccgcctcccccccccccccccccccctccacagccgcctcccccccccccccccacccgcctggcccctctactgggcctgccaaggctgcgtcctaacgggcctctgggtcatcgcccacgaatgcggccaccacgccttcagcgactac

SEQ ID NO: 354 - DNA, 261 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttaccacgccttcagcgactac

SEQ ID NO: 355 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatcgcccacgagtgcggccaccacgccttcagcgactac

SEQ ID NO: 356 - DNA, 350 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaactgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 357 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccccccccctctcccttccccctctactgggcctgccaaggctgcgtcctaacgggcctctgggtcatcgcccacgaatgcggccaccacgccttcagcgactac

SEQ ID NO: 358 - DNA, 351 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 359 - DNA, 350 bp, Artificial
  Mutation in BnaC.FAD2.b introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctccccctctctcctacttctggcctctctactgggcctgccagggctgcgtcctaacgggcctctgggtcatagcccacgagtgcggccaccacgccttcagcgactac

SEQ ID NO: 360 - DNA, 421 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctccccccccctctcccttacctctggcaagcaggcgctggagacggtccagcggctgttgccggtgctgtgccaggcccacggcttgacccccctggcccctctactgggcctgccaaggctgcgtcctaacgggcctctgggtcatagcccacgagtgcggccaccacgccttcagcgactac

SEQ ID NO: 361 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctcttcgacatcctcgtctcctcctccctctaccacctctccacagcctacttccctctcctcccccaccctctcccttaccttggcccctctactgggcctgccaaggctgcgtcctaacgggcctctgggtcatagcccacgagtgcggccaccacgccttcagcgactac

SEQ ID NO: 362 - DNA, 340 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccacccgcctggcccctctactgggcctgccaaggctgcgtcctaacgggcctctgggtcatcgcccacgaatgcggccaccacgccttcagcgactac

SEQ ID NO: 363 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttctggcctctctactgggcctgccaagggtgcgtcctaaccggcgtctgggtcatagcccacgagtgcggccaccacgccttcagcgactac

SEQ ID NO: 364 - DNA, 261 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccacactgcttcaaacgctccatcccacgctccttctcctcttcgacatcatcatctcctcctcggctcctccctctaccacctctccacagcctacttccctctcccttaccacgccttcagcgactac

SEQ ID NO: 365 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttctggcctctctactgggcctgccaagggtgcgtcctaaccggcgtctgggtcatagcccacgagtgcggccaccacgccttcagcgactac

SEQ ID NO: 366 - DNA, 357 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgccgcctgacccctctactgggcctgccaaggctgcgtcctaacgggcctctgggtcatagcccacgagtgcggccaccacgccttcagcgactac

SEQ ID NO: 367 - DNA, 340 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgggagacaccacccttcactctcggagacctcaagaaagcaatcccacctcactgcttcaaacgctccatccctcgctccttctcctacctcctcttcgacatcctcgtctcctcctccatctaccacctctccacagcctacttccctctcctcccccaccctccccccccctctactgggcctgccaaggctgcgtcctaacgggcctctgggtcatcgcccacgagtgcggccaccacgccttcagcgactac

SEQ ID NO: 368 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 369 - DNA, 346 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctctactgggcctgccaagggtgcgtcctaaccggcgtctgggtcatagcccacgagtgcggccaccacgccttcagcgactac

SEQ ID NO: 370 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcatcatctcctcctcggctcctccctctaccacctctccacagcctacttccctctcctccctcaccctctctcctacttcctcgctactgggcctgccaagggtgcgtcctaaccggcgtctgggtcatagcccacgagtgcggccaccacgccttcagcgactac

SEQ ID NO: 371 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 372 - DNA, 338 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttccctctcccttacctcgcctgaccctctactgggcctgccaaggctgcgtcctaacgggcctctgggtcatagcccacgagtgcggccaccacgccttcagcgactac

SEQ ID NO: 373 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaagggtgcgtcctaaccggcgtctgggtcatagcccacgagtgcggccaccacgccatcagcgactac

SEQ ID NO: 374 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctactggcctctctactgggcctgccaagggtgcgtcctaaccggcgtctgggtcatagcccacgagtgcggccaccacgccttcagcgactac

SEQ ID NO: 375 - DNA, 421 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctctggcaagcaggcgctggagacggtccagcggctgttgccggtgctgtgccaggcccacggcttgacccccctggcccctctactgggcctgccaaggctgcgtcctaacgggcctctgggtcatcgcccacgaatgcggccaccacgccttcagcgactac

SEQ ID NO: 376 - DNA, 349 bp, Artificial
  Mutation in BnaC.FAD2.b introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatagcccacgagtgcggccaccacgccttcagcgactac

SEQ ID NO: 377 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctcccctctactgggcctgccaaggctgcgtcctaacgggcctctgggtcatcgcccacgaatgcggccaccacgccttcagcgactac

SEQ ID NO: 378 - DNA, 331 bp, Artificial
  Mutation in BnaC.FAD2.b introduced by TALE nuclease pair BnFAD2_T01
caggatccatgggtgcaggtggaagaatgcaagtctctcctccctccagctcccccggaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctggcccctctactgggcctgccaagggtgcgtcctaaccggcgtctgggtcatagcccacgagtgcggccaccacgccttcagcgactac

SEQ ID NO: 379 - DNA, 337 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctccgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccctctactgggcctgccaaggctgcgtcctaacgggcctctgggtcatcgcccacgaatgcggccaccacgccttcagcgactac

SEQ ID NO: 380 - DNA, 385 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcgtctcctcatccctctaccacctctccacagcctacttccctctcctcccccgcccgctcccttacctcgctcgccgcagacgaacgaccgagcgcagcgtggcccctctactgggccggccaaggctgcgtcctaacgggcctctgggtcatcgcccacgaaggcggccaccacgccttcagcgactac

SEQ ID NO: 381 - DNA, 352 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttaccccgccgggccctctacggggcctgccaaggctgcgtcctaacgggcctctgggtcatagcccacgagtgcggccaccacgccttcagcgactac

SEQ ID NO: 382 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggccccgctactgggcctgccaaggctgcgtcctaacgggcctctgggtcatagcccacgagtgcggccaccacgccttcagcgactac

SEQ ID NO: 383 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcgtctgggtcatagcccacgagtgcggccaccacgccttcagcgactac

SEQ ID NO: 384 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttggcctctctactgggcctgccagggctgcgtcctaaccggcgtctgggtcatagcccacgagtgcggccaccacgccttcagcgactac

SEQ ID NO: 385 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgctacaaacgctccatccctcgctccttctcctacctcctcttcgacatcctcgtctcctcctccctctaccacctctccacagcctacttccctctcctcccccaccctctcccttacctgcccctctactgggcctgccaaggctgcgtcctaacgggcctctgggtcatcgcccacgaatgcggccaccacgccttcagcgactac

SEQ ID NO: 386 - DNA, 339 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttactgggcctgccagggctgcgtcctaaccggcgtctgggtcatagcccacgagtgcggccaccacgccttcagcgactac

SEQ ID NO: 387 - DNA, 350 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttaccgctggcccctctactgggcctgccaaggctgcgtcctaacgggcctctgggtcatcgcccacgaatgcggccaccacgccttcagcgactac

SEQ ID NO: 388 - DNA, 355 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcgcctggcccctctactgggcctgccaagggtgcgtcctaaccggcgtctgggtcatagcccacgagtgcggccaccacgccttcagcgactac

SEQ ID NO: 389 - DNA, 350 bp, Artificial
  Mutation in BnaC.FAD2.b introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 390 - DNA, 421 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctctggcaagcaggcgctggagacggtccagcggctgttgccggtgctgtgccaggcccacggcttgacccccctggcccctctactgggcctgccaaggctgcgtcctaacgggcctctgggtcatagcccacgagtgcggccaccacgccttcagcgactac

SEQ ID NO: 391 - DNA, 312 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctgggtctgccaaggctgcgtcctaacgggcctctgggtcatagcccacgagtgcggccaccacgccttcagcgactac

SEQ ID NO: 392 - DNA, 388 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacaacggctgataggatcccccaatccctttttcactgcacctggcccctctactgggcctgccaaggctgcgtcctaacgggcctctgggtcatcgcccacgaatgcggccaccacgccttcagcgactac

SEQ ID NO: 393 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctactgggcctgccaaggctgcgtcctaacgggcctctgggtcatcgcccacgaatgcggccaccacgccttcagcgactac

SEQ ID NO: 394 - DNA, 381 bp, Artificial
  Mutation in BnaC.FAD2.b introduced by TALE nuclease pair BnFAD2_T01
caggatccatgggtgcaggtggaagaatgcaagtgtctcctccctcccgctcccccgaaaccaaaaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgctcgccgcagcctaacgaccgagcgcagcgtggcccctctactgggcctgccaaggctgcgtcctaacgggcctctgggtcatcgcccacgaatgcgtccacgacgcctgcagctactac

SEQ ID NO: 395 - DNA, 349 bp, Artificial
  Mutation in BnaC.FAD2.b introduced by TALE nuclease pair BnFAD2_T01
caggatccatgggtgcaggtggaagaatgcaagtctctactccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttcccttggcccctctactgggcctgccaaggctgcgtcctaacgggcctctgggtcatctcccacgaatgcggccaccacgccttcagcgactac

SEQ ID NO: 396 - DNA, 327 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatagcctcctgcttctactacgtcgccaccacttacttccctctcctccctcaccctctctctactgggcctgccagggctgcgtcctaaccggcgtctgggtcatagcccacgagtgcggccaccacgccttcagcgactac

SEQ ID NO: 397 - DNA, 340 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttacctcgtcgtggcccctctactgggcctgccaaggctgcgtcctaacgggcctctgggtcatcgcccacgaatgcggccaccacgccttcagcgactac

SEQ ID NO: 398 - DNA, 331 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccctggcccctctactgggcctgccaaggctgcgtcctaacgggcctctgggtcatcgcccacgaatgcggccaccacgccttcagctactac

SEQ ID NO: 399 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcggcctctctactgggcctgccaagggtgcgtcctaaccggcgtctgggtcatagcccacgagtgcggccaccacgccttcagcgactac

SEQ ID NO: 400 - DNA, 355 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctccttcctggcccctctactgggcctgccaaggctgcgtcctaacgggcctctgggtcatcgcccacgaatgcggccaccacgccttcagcgactac

SEQ ID NO: 401 - DNA, 358 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctcgtctggcccctctaccgggcctgcaaaggctgcgtcctaacgggcctctgggtcatcgcccacgaatgcggccaccacgccttcagcgactac

SEQ ID NO: 402 - DNA, 349 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggccccactactgggcctgccaaggctgcgtcctaacgggcctctgggtcatcgcccacgaatgcggccaccacgccttcagcgactac

SEQ ID NO: 403 - DNA, 324 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttcgcctggcctctctactgggcctgccaagggtgcgtcctaaccggcgtctgggtcatagcccacgagtgcggccaccacgccttcagcgactac

SEQ ID NO: 404 - DNA, 455 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccccgcctgctggcgatgcccaccacctgctccggggtcaagccgtgggcctggcacagcaccggggcggcgtgaccgcagtggaggcagtgcatgcatggcgctcgcctggcccctctactgggcctgccaaggctgcgtcctaacgggcctctgggtcatcgcccacgaatgcggccaccacgccttcagcgactac

SEQ ID NO: 405 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctggcccctctactgggcctgccaaggctgcgtcctaacgggcctctgggtcatcgcccacgaatgcggccaccacgccttcagcgactac

SEQ ID NO: 406 - DNA, 344 bp, Artificial
  Mutation in BnaC.FAD2.b introduced by TALE nuclease pair BnFAD2_T01
caggatccatgggtgcaggtggaagaatgcaagtgtctcctccctcaagctcccccggaaccaacacccccaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttggcccctctactgggcctgccaaggctgcgtcctaacgggcctctgggtcatcgcccacgaatgcggccaccacgccttcagcgactac

SEQ ID NO: 407 - DNA, 354 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctccgcctggcccctctactgggcctgccaaggctgcgtcctaaccggcgtctgggtcatagcccacgagtgcggccaccacgccttcagcgactac

SEQ ID NO: 408 - DNA, 345 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatcccacgctccttctcctcttcgacatcctcgtctcctcctccctctaccacctctccacagcctacttccctctcctcccccaccctctcccttacctcgccggcccctctactgggcctgccaaggctgcgtcctaacgggcctctgggtcatcgcccacgaatgcggccaccacgccttcagcgactac

SEQ ID NO: 409 - DNA, 372 bp, Artificial
  Mutation in BnaC.FAD2.b introduced by TALE nuclease pair BnFAD2_T01
caggatccatgggtgcaggtggcagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctccagcggctgttgccgccatcgtgcccctctactgggcctgccaagggtgcgtcctaaccggcgtctgggtcatagcccacgagtgcggccaccacgccttcagcgactac

SEQ ID NO: 410 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccggcccctctactgggcctgccaaggctgcgtcctaacgggcctctgggtcatagcccacgagtgcggccaccacgccttcagcgactac

SEQ ID NO: 411 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 412 - DNA, 323 bp, Artificial
  Mutation in BnaC.FAD2.b introduced by TALE nuclease pair BnFAD2_T01
caggatccatgggtgcaggtggcagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttcgcctggcctctctactgggcctgccaagggtgcgtcctaaccggcgtctgggtcatagcccacgagtgcggccaccacgccttcagcgactac

SEQ ID NO: 413 - DNA, 373 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctctccagcggctgttgccgccatcgtgcccctctactgggcctgccaaggctgcgtcctaacgggcctctgggtcatcgcccacgaatgcggccaccacgccttcagcgactac

SEQ ID NO: 414 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctaaagaaagcaatcccacctcactgcttcaaacgctccatccctcgctccttctcctcttcgacatcatcatctcctcctcggctcctccctctaccacctctccacagcctacttccctctcctccctcaccctctctccttcggctctctactgggcctgccaaggctgcgtcctaacgggcctctgggtcatcgcccacgaatgcggccaccacgccttcagcgactac

SEQ ID NO: 415 - DNA, 328 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatagcctcctgcttctactacgtcgccaccacttacttccctctcctccctcaccctcctctctactgggcctgccaagggtgcgtcctaaccggcgtctgggtcatagcccacgagtgcggccaccacgccttcagcgactac

SEQ ID NO: 416 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagccgacttccctctcctcccccaccctctccctaaccccgcccctctactgggccggccaaggctgcttcctaacgggcctctgggtcatcgccctcaaatgcggccaccacgccttcagcgactac

SEQ ID NO: 417 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcggcctctctactgggcctgccaagggtgcggcctaacgggcctctgggtcatcgcccacaaatgcggccaccacgccttcagcgactac

SEQ ID NO: 418 - DNA, 337 bp, Artificial
  Mutation in BnaC.FAD2.b introduced by TALE nuclease pair BnFAD2_T01
caggatccatgggtgcaggtggaagaatgcaagtctctcctctctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctcgcccctctactgggcctgccaaggctgcgtcctaacgggcctctgggtcatcgcccacgaatgcggccaccacgccttcagcgactac

SEQ ID NO: 419 - DNA, 346 bp, Artificial
  Mutation in BnaC.FAD2.b introduced by TALE nuclease pair BnFAD2_T01
caggatccatgggtgcaggtggaagaatgcaagtgtctcctccctccaagaagtctgaaacctacaccatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttatggcccctctactgggcctgccaaggctgcgtcctaacgggcctctgggtcatagcccacgagtgcggccaccacgccttcagcgactac

SEQ ID NO: 420 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgcttcaaacgctccatccctcgctccttctcctacctcctcttcgacatcctcgtctcctcctccctctaccacctctccacagcctacttccctctcctcccccaccctctcccttacctcgccctggcccctctactgggcctgccaaggctgcgtcctaacgggcctctgggtcatcgcccacgaatgcggccaccacgccttcagcgactac

SEQ ID NO: 421 - DNA, 313 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctcaccctctctcctactttggcctctctactgggcctgccagggctgcgtcctaacgggcctctgggtcatagcccacgagtgcggccaccacgccttcagcgactac

SEQ ID NO: 422 - DNA, 310 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctcaccctctctcctacggcctctctactgggcctgccagggctgcgtcctaaccggcgtctgggtcatagcccacgagtgcggccaccacgccttcagcgactac

SEQ ID NO: 423 - DNA, 348 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttgcctggcccctctactgggcctgccaaggctgcgtcctaaccggcgtctgggtcatagcccacgagtgcggccaccacgccttcagcgactac

SEQ ID NO: 424 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccgccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttggcctctctactgggcctgccaagggtgcgtcctaaccggcgtctgggtcatagcccacgagtgcggccaccacgccttcagcgactac

SEQ ID NO: 425 - DNA, 352 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactgtcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttcccccgctggcccctctactgggcctgccaaggctgcgtcctaacgggcctctgggtcatcgcccacgaatgcggccaccacgccttcagcgactac

SEQ ID NO: 426 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctactttggcctctctactgggcctgccaagggtgcgtcctaaccggcgtctgggtcatagcccacgagtgcggccaccacgccttcagcgactac

SEQ ID NO: 427 - DNA, 341 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctctggcccctctactgggcctgccaaggctgcgtcctaacgggcctctgggtcatcgcccacgaatgcggccaccacgccttcagcgactac

SEQ ID NO: 428 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatagcccacgagtgcggccaccacgccttcagcgactac

SEQ ID NO: 429 - DNA, 421 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccatagcctacttccctctcctcccccaccctctcccttccctctggcaagcaggcgctggagacggtccagcggctcttgccggtgctgtgccaggcccacggcttgacccccctggcccctctactcggcctgccaaggctgcgtcctaacgggcctctgggtcatagcccacgagtgcggccaccacgccttcagcgacgac

SEQ ID NO: 430 - DNA, 346 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcccctctactgggcctgccaaggctgcgtcctaacgggcctctgggtcatcgcccacgaatgcggccaccacgccttcagcgactac

SEQ ID NO: 431 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcaagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatagcccacgagtgcggccaccacgccttcagcgactac

SEQ ID NO: 432 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcctccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcatacttccctctcctccccctccctctcccttaccttggcccctctactgggcctgccaaggctgcgtcctaacgggcctctgggtcatcgcccacgaatgcggccaccacgcctgcagcgactac

SEQ ID NO: 433 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctactttggcctctttactgggcctgccagggctgcgtcctaacgggcctctgggtcatagcccacgagtgcggccaccacgccttcagcgactac

SEQ ID NO: 434 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttcccttggcccctctactgggcctgccaaggctgcgtcctaacgggcctctgggtcatagcccacgagtgcggccaccacgccttcagcgactac

SEQ ID NO: 435 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttaccccctctactgggcctgccaagcctgcgtcctaacgggcctctgggtcatcgcccacgaatgcggccaccacgccttcagcgactac

SEQ ID NO: 436 - DNA, 357 bp, Artificial
  Mutation in BnaC.FAD2.b introduced by TALE nuclease pair BnFAD2_T01
caggatccatgggtgcaggtggaagaatgcaagtctctactccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgccacctggcccctctactgggcctgccaaggctgcgtcctgacggtccgctgggtcatcgcccacgaatgcggccaccacgccttcagtgactac

SEQ ID NO: 437 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgccccttctcctacctcctcttcgacatcctcgtctcctcctccctctaccacctctccacagcctacttccctctcctcccccaccctctctcctactttggcctctctactgggcctgccaagggtgcgtcctaaccggcggctgggtcatagcccacgagtgcggccaccacgcctgcagcgactc

SEQ ID NO: 438 - DNA, 423 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctccatacacagcccagcttggagcgaacgacctacaccgaactgagatacctacagcgtgagctatgagaaagcgccacgctatggcccctctactgggcctgccaaggctgcgtcctaaccggcgtctgggtcatagcccacgagtgcggccaccacgccttcagcgactac

SEQ ID NO: 439 - DNA, 340 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctcctcccccaccctctcccttacctcgcctcgtctggcccctctactgggcctgccaaggctgcgtcctaacgggcctctgggtcatagcccacgagtgcggccaccacgccttcagcgactac

SEQ ID NO: 440 - DNA, 341 bp, Artificial
  Mutation in BnaC.FAD2.b introduced by TALE nuclease pair BnFAD2_T01
caggatccatgggtgcaggtggcagaatgcaagtctctcctccctccagctcccccgaaaccaaaaccctcaaacgcgtcccctgcgagacaccacccttcactctcggagacctcaagaaagcaatccacctcactggttcaaacgctccatcccccgctccttcccctaccccctcctcgacatcctcgtctcctcctccctctaccacctccccacagcctacttccctctcctcccccaccctctcccttacccctctacggggcctgccaaggctgcgtcctaacgggcctctgggtcatcgcccacgaatgcgtccaccacgccttcatcgactc

SEQ ID NO: 441 - DNA, 335 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgctgccaagggtgcgtcctaaccggcgtctgggtcatagcccacgagtgcggccaccacgccttcagcgactac

SEQ ID NO: 442 - DNA, 329 bp, Artificial
  Mutation in BnaC.FAD2.b introduced by TALE nuclease pair BnFAD2_T01
caggatccatgggtgcaggtggaagaatgcaagtgtatcctccctccaagaagactgaaaccgacaccatcaagcgcgtaccctgcgagacaccacccttcactctcggagacctcaagaaagcaatcccacctcactgcttcaaacgctccatccctcgctccttctcctacctcctcttcgacatcctcgtctcctcctccctctaccacctctcctcccccaccctctcccttacctcgcccctctactgggccttccaaggctgcgtcctaacgggcctctgggtcatagcccacgagtgcggccaccacgccttcagtaactac

SEQ ID NO: 443 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttgcccctctactgggcctgccaaggctgcgtcctaacgggcctctgggtcatcgcccacgaatgcggccaccacgccttcagcgactac

SEQ ID NO: 444 - DNA, 346 bp, Artificial
  Mutation in BnaC.FAD2.b introduced by TALE nuclease pair BnFAD2_T01
caggatccatgggtgcaggtggaagaatgcaagtctctaatccctccagctcccccgaaaccaaaaccctcaaacgcgtcccctgagacacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctgccctctactgggcctgccaaggctgcgtcctaacgggcctctgggtcatcgcccacgaatgcggccaccacggcttcagcgactac

SEQ ID NO: 445 - DNA, 355 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcgcctggcccctctactgggcctgccaaggctgcgtcctaacgggcctctgggtcatcgcccacgaatgcggccaccacgccttcagcgactac

SEQ ID NO: 446 - DNA, 312 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggcccttccctcaccccctctcccgcctggcctctctactgggcctgccaagggtgcgtcctaaccggcgtctgggtcatagcccacgagtgcggccaccacgccttcagcgactac

SEQ ID NO: 447 - DNA, 345 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctccctctactgggcctgccaaggctgcgtcctaacgggcctctgggtcatcgcccacgaatgcggccaccacgccttcagcgactac

SEQ ID NO: 448 - DNA, 336 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctgggcctgccaaggctgcgtcctaacgggcctctgggtcatcgcccacgaatgcggccaccacgccttcagcgactac

SEQ ID NO: 449 - DNA, 353 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccctggcccctctactgggcctgccaaggctgcgtcctaacgggcctctgggtcatagcccacgagtgcggccaccacgccttcagcgacta

SEQ ID NO: 450 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttggcctctctactgggcctgccaagggtgcgtcctaaccggcgtctgggtcatagcccacgagtgcggccaccacgccttcagcgactac

SEQ ID NO: 451 - DNA, 348 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatagcccacgagtgcggccaccacgccttcagcgactac

SEQ ID NO: 452 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccgaacccaaaaccctcaaacccgtcccctgcgagcccccccccttcactctcggagacctcaagaaagcaatcccacctcactgcttcaaacgctccatcccacgctccttctcctcttcgacatcctcgtctcctcctccctctaccacctctccacagcctacttccctctcctccccccccctctcccttacctcgccctggcccctctactgggcctgccaaggctgcgtcctaacgggcctctgggtcatcgcccacgaatgcggccaccacgccttcagcgactac

SEQ ID NO: 453 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctggcccctctactgggcctgccaaggctgcgtcctaacgggcctctgggtcatagcccacgagtgcggccaccacgccttcagcgactac

SEQ ID NO: 454 - DNA, 354 bp, Artificial
  Mutation in BnaC.FAD2.b introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatccctcgctccttctcctacctcctcttcgacatcctcgtctcctcctccctctaccacctctccacagcctacatccctctcctcccccaccctctcccttacctccgcctggcccctctactgggcctgccagggctgcgtcctaaccggcgtctgggtcatagcccacgagtgcggccaccacgccttcagcgactac

SEQ ID NO: 455 - DNA, 338 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttacctcgcctgaccctctactgggcctgccaaggctgcgtcctaaccggcgtctgggtcatagcccacgagtgcggccaccacgccttaagcgactac

SEQ ID NO: 456 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttaccttggcccctctactgggcctgccaaggctgcgtcctaacgggcctctgggtcatagcccacgagtgcggccaccacgccttcagcgactac

SEQ ID NO: 457 - DNA, 348 bp, Artificial
  Mutation in BnaC.FAD2.b introduced by TALE nuclease pair BnFAD2_T01
caggatccatgggtgcaggtggcagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaaccggcgtcggggtcatagcccacgagtgcggccaccacgcctgcagcgactac

SEQ ID NO: 458 - DNA, 346 bp, Artificial
  Mutation in BnaC.FAD2.b introduced by TALE nuclease pair BnFAD2_T01
caggatccatgggtgcaggtggcagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacggcctctctactgggcctgccaagggtgcgtcctaaccggcgtctgggtcatagcccacgagtgcggccaccacgccttcagcgactac

SEQ ID NO: 459 - DNA, 348 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 460 - DNA, 347 bp, Artificial
  Mutation in BnaC.FAD2.b introduced by TALE nuclease pair BnFAD2_T01
caggatcaatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctccaggcctctctactgggcctgccagggctgcgtcctaaccggcgtctgggtcatagcccacgagtgcggccaccacgccttcagcgactac

SEQ ID NO: 461 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctccttcctcaccctctctcctacttggcctctctactgggcctgccagggctgcgtcctaaccggcgtctgggtcatagcccacgagtgcggccaccacgccttcagcgactac

SEQ ID NO: 462 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcggcccctctactgggcctgccaaggctgcgtcctaacgggcctctgggtcatcgcccacgaatgcggccaccactccttcagcgactac

SEQ ID NO: 463 - DNA, 346 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctccccccccctctcccttacctcgcctctactgggcctgccaaggctgcgtcctaacgggcctctgggtcatcgcccacgaatgcggccaccacgccttcagcgactac

SEQ ID NO: 464 - DNA, 315 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctcaccctctctcctacttcggggcctctctactgggcctgccaagggtgcgtcctaaccggcgtctgggtcatagcccacgagtgcggccaccacgccttcagcgactac

SEQ ID NO: 465 - DNA, 311 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctcaccctctctcctacttacctctctactgggcctgccaagggtgcgtcctaaccggcgtctgggtcatagcccacgagtgcggccaccacgccttcagcgactac

SEQ ID NO: 466 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccatcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttgccttggcccctctactgggcctgccagggctgcgtcctaacgggcctctgggtcatcgcccacgaatgcggccaccacgccttcagcgactac

SEQ ID NO: 467 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctccctggcccctctactgggcctgccaaggctgcgtcctaacgggcctctgggtcatcgcccacgaatgcggccaccacgccttcagcgactac

SEQ ID NO: 468 - DNA, 353 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcttgcctcgccgtttctctctactgttttttccaatgctgcgtcctaatttgcctcttggtcatcgcccaccaatgcggccaccacgccttcagcgactac

SEQ ID NO: 469 - DNA, 349 bp, Artificial
  Mutation in BnaC.FAD2.b introduced by TALE nuclease pair BnFAD2_T01
caggatccatgggtgcaggtggaagaatgcaagtatatcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctccctcaccctctctcctacttcgccgcctggcctctctactgggcctgccaagggtgcgtcctgaccggggtcggggtcatagcgcacgagtgcgtccaccacgccttcagcgactgc

SEQ ID NO: 470 - DNA, 347 bp, Artificial
  Mutation in BnaC.FAD2.b introduced by TALE nuclease pair BnFAD2_T01
caggatccatgggtgcaggtggcagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctactgcctctctactgggcctgccaagggtgcgtcctaaccggcgtctgggtcatagcccacgagtgcggccaccacgccttcagcgactac

SEQ ID NO: 471 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctctggcccctctactgggcctgccaaggctgcgtcctaacgggcctctgggtcatcgcccacgaatgcggccaccacgccttcagcgactac

SEQ ID NO: 472 - DNA, 355 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgccctggcccctctactgggcctgccaaggctgcgtcctaacgggcctctgggtcatcgcccacgaatgcggccaccacgccttcagcgactac

SEQ ID NO: 473 - DNA, 342 bp, Artificial
  Mutation in BnaC.FAD2.b introduced by TALE nuclease pair BnFAD2_T01
caggatccatgggtgcaggtggcagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccctctactgggcctgccaaggctgcgtcctaacgggcctctgggtcatagcccacgagtgcggccaccacgccttcagcgactac

SEQ ID NO: 474 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctttaccccccccccacagcctacttccctcccctccccccccctctcccgtatggcccctctactgggcctgccaaggctgcgtcctaacgggcctctgggtcatcgcccacgagtgcggccaccacgccttcagcgactac

SEQ ID NO: 475 - DNA, 349 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 476 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctactttggcctctctactgggcctgccaagggtgcgtcctagccggcctctgggtcatagcccacgagtgcggccaccacgccttcagcgactac

SEQ ID NO: 477 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttatggcccctctactgggcctgccaaggctgcgtcctaaccggcgtctgggtcatagcccacgagtgcggccaccacgccttcagcgactac

SEQ ID NO: 478 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagccacgatggcggcaagcaggcgctggagcctggcccctctactgggcctgccaaggctgcgtcctaaccggcgtctgggtcatagcccacgagtgcggccaccacgccttcagcgactac

SEQ ID NO: 479 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcccctctactgggcctgccaaggctgcgtcctaacgggcctctgggtcatcgcccacgaatgcggccaccacgccttcagcgactac

SEQ ID NO: 480 - DNA, 343 bp, Artificial
  Mutation in BnaC.FAD2.b introduced by TALE nuclease pair BnFAD2_T01
caggatccatgggtgcaggtggaagaatgcaagtatctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 481 - DNA, 351 bp, Artificial
  Mutation in BnaC.FAD2.b introduced by TALE nuclease pair BnFAD2_T01
caggatcatgggtgcaggtggaagaatgcaagtctctcctccctccagctccccaggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgctggcccctctactgggcctgccaaggctgcgtcctaacgggcctctgggtcatcgcccacgaatgcggccaccacgccttcagcgactac

SEQ ID NO: 482 - DNA, 343 bp, Artificial
  Mutation in BnaC.FAD2.b introduced by TALE nuclease pair BnFAD2_T01
caggatccatgggtgcaggtggaagaatgcaagtgtcttctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctccctggcccctctactgggcctgccaaggctgcgtcctaacgggcctctgggtcatcgcccacgaatgcggccaccacgccttcagcgactac

SEQ ID NO: 483 - DNA, 390 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttgctggcggtggcaagcccctgctggggggtcaagccgtgggcggcctctctactgggcctgccaagggtgcgtcctaaccggcgtctgggtcatagcccacgagtgcggccaccacgccttcagcgactac

SEQ ID NO: 484 - DNA, 329 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctactgccaagggtgcgtcctaacgggcctctgggtcatcgcccacgagtgcggccaccacgccttcagcgactac

SEQ ID NO: 485 - DNA, 349 bp, Artificial
  Mutation in BnaC.FAD2.b introduced by TALE nuclease pair BnFAD2_T01
caggatccatgggtgcaggtggaagaatgcaagtatctcctccctccagctcccccgaaaccaaaaccctcaaacgcgtcccctgcgagacaccacccttcactctcggagacctcaagaaaacaatcccacctcactgcttcaaacgctccatccctcgccccttctcctacctcatctgggacatcatcatagcctcctgcttctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 486 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctcacctggcccctctactgggcctgccaagggtgcgtcctaaccggcgtctgggtcatagcccacgagtgcggccaccacgccttcagcgactac

SEQ ID NO: 487 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatagcccacgagtgcggccaccacgccttcagcgactac

SEQ ID NO: 488 - DNA, 341 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctctactgggcctgccaaggctgcgtcctaacgggcctctgggtcatcgcccacgaatgcggccaccacgccttcagcgactac

SEQ ID NO: 489 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 490 - DNA, 348 bp, Artificial
  Mutation in BnaC.FAD2.b introduced by TALE nuclease pair BnFAD2_T01
caggatccatgggtgcaggtggaagaatgcaagtgtctcctccatccaaaaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttccctggcccctctactgggcctgccaaggctgcgtcctaacgggcctctgggtcatcgcccacgaatgcggccaccacgccttcagcgactac

SEQ ID NO: 491 - DNA, 344 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccacccgcgcccttaccccctctactgggcctgccaaggctgcgtcctaacgggcctctgggtcatcgcccacgaatgcggccaccacgcctgcagcgactac

SEQ ID NO: 492 - DNA, 259 bp, Artificial
  Mutation in BnaC.FAD2.b introduced by TALE nuclease pair BnFAD2_T01
caggatcctgggtgcaggtggaagaatgcaagtctcccctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacatcctacttccctctcccttaccacgccttcagcgactac

SEQ ID NO: 493 - DNA, 343 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctggcccctctactgggcctgccaaggctgcgtcctaacgggcctctgggtcatagcccacgagtgcggccaccacgccttcagcgactac

SEQ ID NO: 494 - DNA, 356 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcaatcccacgctccttctcctcttcgacatcatcatctcctcctcggctcctccctctaccacctctccacagcctacttccctctcctcccccaccctctcccttccctacttcctggcccctctactgggcctgccaaggctgcgtcctaacgggcctctgggtcatcgcccacgaatgcggccaccacgccttcagcgactac

SEQ ID NO: 495 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttatggcccctctactgggcctgccaaggctgcgtcctaacgggcctctgggtcatcgcccacgaatgcggccaccacgccttcagcgactac

SEQ ID NO: 496 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccgaaaccgacaccatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttaccctctactgggcctgccaaggctgcgtcctaacgggcctctgggtcatcgcccacgaatgcgtccaccacgccttcagcgactac

SEQ ID NO: 497 - DNA, 418 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttagccgtagttagccccccccttcaagaactctgtagccccgcctacatacctcgctctgctaatcctgttacctggcccctctactgggcctgccaaggctgcgtcctaacgggcctctgggtcatcgcccacgaatgcggccaccacgccttcagcgactac

SEQ ID NO: 498 - DNA, 342 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatcccacgctccttctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcggccaccacgcctgcagcgactac

SEQ ID NO: 499 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctcacctcgctggcccctctactgggcctgccaaggctgcgtcctaacgggcctctgggtcatcgcccacgaatgcggccaccacgccttcagcgactac

SEQ ID NO: 500 - DNA, 315 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctcttcgacatcatcatctcctcctcggctcctccctcaccctctctcctacttcgcggcctctctactgggcctgccagggctgcgtcctaaccggcgtctgggtcatagcccacgagtgcggccaccacgccttcagcgactac

SEQ ID NO: 501 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctcttcgacatcctcgtctcctcctccctctaccacctctccacagcctacttccctctcctcccccaccctcccccttacctctggcccctctactgggcctgccaaggctgcgtcctaacgggcctctgggtcatcgcccacgaatgcggccaccacgccttcagcgactac

SEQ ID NO: 502 - DNA, 312 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctccctcctcttccccaccctcctcccctcctccctccaccccctctccccaccctacttccctctgggcctgccaaggctgcgtcctaacgggcctctgggtcatcgcccacgaatgcggccaccacgccttcagcgactac

SEQ ID NO: 503 - DNA, 349 bp, Artificial
  Mutation in BnaC.FAD2.b introduced by TALE nuclease pair BnFAD2_T01
caggatccatgggtgcaggtggaagaatgcaagtatcaactccctcaagctcccccgaaaacaaaaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcttacgaatgcggccaccacgcctacagcgactac

SEQ ID NO: 504 - DNA, 383 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcttacttccctctcctccctcaccctctctcctacttcagcggctgttgccggtgctgtgccaggcccacggcttctctctactgggcctgccaagggtgcgtcctaaccggcgtctgggtcatagcccacgagtgcggccaccacgccttcagcgactac

SEQ ID NO: 505 - DNA, 394 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctaagggcgagatccggtgcagattatttggattgagagtgaatattgcccctctactgggcctgccaaggctgcgtcctaacgggcctctgggtcatcgcccacgaatgcggccaccacgccttcagcgactac

SEQ ID NO: 506 - DNA, 425 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgcttcaaacgctccatccctcgctccttctcctacctcctcttcgacatcctcgtctcctcctccctctaccacctctccacagcctacttccctctcctcccccaccctctcccttacctggcggatttgaacgtggtgaagcaacggcccggagggtggcgggccaccccctgctggggggtcaagccgttggcctggcccctctactgggcctgccaaggctgcgtcctaacgggcctctgggtcatcgcccacgaatgcggccaccacgccttcagcgactac

SEQ ID NO: 507 - DNA, 338 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatcccacgctccttctcctcttcgacatcatcatctcctcctcggctcctccctctaccacctctccacagcctacttccctctcccttacctcgcctggccctctactgggcctgccaaggctgcgtcctaacgggcctctgggtcatcgcccacgaatgcggccaccacgccttcagcgactac

SEQ ID NO: 508 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctgaccccgcctgcccctctactgggcctgccaaggctgcgtcctaacgggcctctgggtcatcgcccacgaatgcggccaccacgccttcagcgactac

SEQ ID NO: 509 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctggcccctctactgggcctgccaaggctgcgtcctaacgggcctctgggtcatcgcccacgaatgcggccaccacgccttcagcgactac

SEQ ID NO: 510 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctccctggcccctctactgggcctgccaaggctgcgtcctaacgggcctctgggtcatcgcccacgaatgcggccaccacgccttcagcgactac

SEQ ID NO: 511 - DNA, 395 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgccgcaaactcttcctggctagcggtacgcgtattaattgcggcctggcctctctactgggcctgccaagggtgcgtcctaacgggcctctgggtcatcgcgcacgaaggcggccaccacgccttcagcgactac

SEQ ID NO: 512 - DNA, 303 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctcaccctctctcctacttactgggcctgccagggctgcgtcctaaccggcgtctgggtcatagcccacgagtgcggccaccacgccttcagcgactac

SEQ ID NO: 513 - DNA, 348 bp, Artificial
  Mutation in BnaC.FAD2.b introduced by TALE nuclease pair BnFAD2_T01
caggatccatgggtgcaggttgaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacaccctcgtctcctcctccctctaccgcctctccacagcctacttccctctcctcccccaccctctcccttacctggcccctctactgggcctgccaaggctgcgtcctaacgggcctctgggtcatagcccacgagtgcggccaccacgccttcagcgactac

SEQ ID NO: 514 - DNA, 332 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctactgggcctgccaagggtgcgtcctaaccggcgtctgggtcatagcccacgagtgcggccaccacgccttcagcgactac

SEQ ID NO: 515 - DNA, 341 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtcccctgcgagacaccacccttcactctcggagacctcaagaaagcaatcccacctcgctgcttcaaacgctccatccctcgctccttctcctacctcctcttcgacatcctcgtctcctcctccctctaccacctctccacagcctacttccctctcctcccccaccctctcccttacctctactgggcctgccaaggctgcgtcctaacgggcctctgggtcatcgcccacgaatgcggccaccacgccttcagcgactac

SEQ ID NO: 516 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagccacgatggcggcaagcaggcgctggagcctggcccctctactgggcctgccaaggctgcgtcctaacgggcctctgggtcatcgcccacgaatgcggccaccacgccttcagcgacac

SEQ ID NO: 517 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcacctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcccctctactgggcctgccaaggctgcgtcctaacgggcctctgggtcatcgcccacgaatgcggccaccacgccttcagcgactac

SEQ ID NO: 518 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagatctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcccctctactgggcctgccaaggctgcgtcctaacgggcctctgggtcatcgcccacgaatgcggccaccacgccttcagcgactac

SEQ ID NO: 519 - DNA, 322 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttcgcggcctctctactgggcctgccagggctgcgtcctaaccggcgtctgggtcatagcccacgagtgcggccaccacgccttcagcgactac

SEQ ID NO: 520 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccggcccctctactgggcctgccaaggctgcgtcctaacgggcctctgggtcatcgcccacgaatgcggccaccacgccttcagcgactac

SEQ ID NO: 521 - DNA, 352 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcgaagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttaccccgccggcccctctactgggcctgccaaggctgcgtcctaacgggcctctgggtcatcgcccacgaatgcggccaccacgccttcagcgactac

SEQ ID NO: 522 - DNA, 338 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctccccccccaccctctccccctctactgggcctgccaaggctgcgtcctaacgggcctctgggtcatcgcccacgaatgcggccaccacgccttcagcgactac

SEQ ID NO: 523 - DNA, 336 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatagcctcctgcttctactacgtcgccaccacttacttccctctcctccctcaccctctctcctaactctctactgggccggccaagggtgcgtcctaacgggcctctgggtcatagcccacgagtgcggccaccacgccttcagcgactac

SEQ ID NO: 524 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgctgccaccacgccttcagcgactac

SEQ ID NO: 525 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctccaacttggcctctctactgggcctgccaagggtgcgtcctaaccggcgtctgggtcatagcccacgagtgcggccaccacgccttcagcgactac

SEQ ID NO: 526 - DNA, 311 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcgcctcctccctcaccctctctcctactggcctctctactgggcctgccagggctgcgtcctaaccggcgtctgggtcatagcccacgagtgcggccaccacgccttcagcgactac

SEQ ID NO: 527 - DNA, 338 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccccctctactgggcctgccaaggctgcgtcctaaccggcgtctgggtcatagcccacgagtgcggccaccacgccttcagcgactac

SEQ ID NO: 528 - DNA, 319 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctcaccctctctcctacttcgcccctggcccctctactgggcctgccaaggctgcgtcctaacgggcctctgggtcatcgcccacgaatgcggccaccacgccttcagcgactac

SEQ ID NO: 529 - DNA, 357 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcacttacctcgccgcctggcccctctactgggcctgccaaggctgcgtcctaacgggcctctgggtcatcgcccacgaatgcggccaccacgccttcagcgactac

SEQ ID NO: 530 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacatggcctctctactgggcctgccaagggtgcttcctaaccggcgtctgggtcatagcccacgagtgcggccaccacgccttcagcgactac

SEQ ID NO: 531 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctcccccaccctctcccttccctgcccctctactgggcctgccaaggctgcgtcctaacgggcctctgggtcatcgcccacgaatgcggccaccacgccttcagcgactac

SEQ ID NO: 532 - DNA, 358 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccggtttgcgtattgccgctgcctggcctctctactgggcctgccaagggtgcgtcctaaccggcgtctgggtcatagcccacgagtgcggccaccacgccttcagcgactac

SEQ ID NO: 533 - DNA, 348 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 534 - DNA, 313 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctgggtctgccaaggctgcgtcctaacgggcgtctgggtcatagcccacgagtgcggccaccacgccttcagcgactac

SEQ ID NO: 535 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctctggcccctctactgggcctgccaaggctgcgtcctaacgggcctctgggtcatcgcccacgaatgcggccaccacgccttcagcgactac

SEQ ID NO: 536 - DNA, 340 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctcccacctctccacagcctacttccctctcctcccccacccgcctggcccctctactgggcctgccaaggctgcgtcctaacgggcctctgggtcatcgcccacgaatgcggccaccacgccttcagcgactac

SEQ ID NO: 537 - DNA, 261 bp, Artificial
  Mutation in BnaC.FAD2.b introduced by TALE nuclease pair BnFAD2_T01
caggatccatgggtgcaggtggcagaatgcaagtctctcctccctccagctcccccgaaaccaaaaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttaccacgccttcagcgactac

SEQ ID NO: 538 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaatcaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctccctcacctgcccctctactgggcctgccaaggctgcgtcctaacgggcctctgggtcatcgcccacgaatgcggccaccacgccttcagcgactac

SEQ ID NO: 539 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccatcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctctcctacttctctctactgggcctgccaagggtgcgtcctaaccggcgtctgggtcatagcccacgagtgcggccaccacgccttcagcgactac

SEQ ID NO: 540 - DNA, 339 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgccggcctgccagggctgcgtcctaaccggcgtctgggtcatagcccacgagtgcggccaccacgccttcagcgactac

SEQ ID NO: 541 - DNA, 340 bp, Artificial
  Mutation in BnaC.FAD2.b introduced by TALE nuclease pair BnFAD2_T01
caggatccatgggtgcagggggaagaatgcaagtctctcctccctccagctcccccgaaaccaaaaccctcaaacgcgtcccctgcgagacaccacccttcactctcggagacctcaagaaagcaatcccacctcactgcttcaaacgacccatccctcgctccttctcctacctcctcttcgacatcctcgtctcctcctccctctaccacctctccacagcctacttctctctcctcccccaccctctcccgccctctactgggcctgccaaggctgcgtcctaacgggcctctggttcatagcccacgagtgcggccaccacgccttcagcgactac

SEQ ID NO: 542 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcccggcctctctactgggcctgccagggctgcgtcctaaccggcgtctgggtcatagcccacgagtgcggccaccacgccttcagcgactac

SEQ ID NO: 543 - DNA, 312 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctcaccctctctcctacttggcctctctactgggcctgccaagggtgcgtcctaacgggcctctgggtcatagcccacgagtgcggccactacgccttcagcgactac

SEQ ID NO: 544 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaatgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 545 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctccgcctggcccctctactgggcctgccaaggctgcgtcctaacgggcctctgggtcatcgcccacgaatgcggccaccacgccttcagcgactac

SEQ ID NO: 546 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctctggcccctctactgggcctgccaaggctgcgtcctaacgggcctctgggtcatcgcccacgaatgcggccaccacgccttcagcgactac

SEQ ID NO: 547 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacccctggcccctctactgggcctgccaagcctgcgtcctaacgggcctctgggtcatcgcccacgagtgcgtccaccacgccttcagcgactac

SEQ ID NO: 548 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttcccccgccggcccctctactgggcctgccaaggctgcgtcctaacgggcctctgggtcatcgcccacgaatgcggccaccacgccttcagcgactac

SEQ ID NO: 549 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccacccactcccttacccctctactgggcctgccaaggctgcgtcctaacgggcctctgggtcatcgcccacgaatgcggccaccacgccttcagcgactac

SEQ ID NO: 550 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacccctctactgggcctgccaaggctgcgtcctaacgggcctctgggtcatcgcccacgaatgcggccaccacgccttcagcgactac

SEQ ID NO: 551 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacccctctactgggcctgccaaggctgcgtcctaatgggcctctgggtcatcgcccacgaatgcggccaccacgccttcagcgactac

SEQ ID NO: 552 - DNA, 348 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctcacctggcccctctactgggcctgccaaggctgcgtcctaacgggcctctgggtcatcgcccacgaatgcggccaccacgccttcagcgactac

SEQ ID NO: 553 - DNA, 335 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagccacgatggcggcaagcaggcgctggagcctggcccctctactgggcctgccaaggctgcgtcctaacgggcctctgggtcatcgcccacgaatgcggccaccacgccttcagcgactac

SEQ ID NO: 554 - DNA, 348 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 555 - DNA, 351 bp, Artificial
  Mutation in BnaC.FAD2.b introduced by TALE nuclease pair BnFAD2_T01
caggatccatgggtgcaggtggaagaatgcaagtctatcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttctggcctctctactgtgccttccagggctgcgtcctaaccgtcttctggatcatatcccacgagtgcggccaccacgccttcagcgactac

SEQ ID NO: 556 - DNA, 381 bp, Artificial
  Mutation in BnaC.FAD2.b introduced by TALE nuclease pair BnFAD2_T01
caggatccatgggtgcaggtggaagaatgcaagtgtatcctccctccaaaaagcctgaaaccgacaacatcaagcgcgtaccctgcgagacaccgcccttcactgtcggagacctcaagaaagcaatcccacctcactgcttcaaacgctccatccctcgctccttctcctacctcctcttcgacatcctcgtctcctcctccctctaccacctctccacaccctacttccctctcctcccccaccctcgcccttccctcgctggccgcagccgaacgaccgagcgcagcgtggcccctctactgggccggcgaaggctgcgtcgtaacgggcctctgggtcatcgcccacgaatgcggccaccacgccttcagcgactac

SEQ ID NO: 557 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctcccccttacctccctggcccctctactgggcctgccaaggctgcgtcctaacgggcctctgggtcatcgcccacgaatgcggccaccacgccttcagcgactac

SEQ ID NO: 558 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttatggcccctctactgggcctgccaaggctgcgtcctaacgggcctctgggtcatcgcccacgaatgcggccaccacgccttcagcgactac

SEQ ID NO: 559 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttatggcccctctactgggcctgccaaggctgcgtcctaacgggcctctgggtcatcgcccacgaatgcggccaccacgccttcagcgactac

SEQ ID NO: 560 - DNA, 358 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacataaagcgcgtaccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctcgtctggcccctctactgggcctgccaaggctgcgtcctaacgggcctctgggtcatcgcccacgaatgcggccaccacgccttcagcgactac

SEQ ID NO: 561 - DNA, 345 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctccttcggctctctactgggcctgccaagggtgcgtcctaaccggcgtctgggtcatagcccacgagtgcggccaccacgccttcagcgactac

SEQ ID NO: 562 - DNA, 343 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacccctctactgggcctgccaaggctgcgtcctaacgggcctctgggtcatcgcccacgaatgcggccaccacgccttcagcgactac

SEQ ID NO: 563 - DNA, 359 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccccccccctctcccttccctcgcctcgtctggcccctctactgggcctgccaaggctgcgtcctaacgggcctctgggtcatagcccacgagtgcggccaccacgccttcagcgactac

SEQ ID NO: 564 - DNA, 295 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctcaccctctctcctgggcctgccaagggtgcgtcctaaccggcgtctgggtcatagcccacgagtgcggccaccacgccttcagcgactac

SEQ ID NO: 565 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 566 - DNA, 331 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctggcccctctactgggcctgccgaggctgcgtcctaacgggcctctgggtcatagcccacgagtgcggccaccacgccttcagcgactac

SEQ ID NO: 567 - DNA, 349 bp, Artificial
  Mutation in BnaC.FAD2.b introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccgccctctcccttaccttggcccctctactgggcctgccaaggctgcgtcctaacgggcctctgggtcatcgcccacgaatgcggccaccacgccttcagcgactac

SEQ ID NO: 568 - DNA, 349 bp, Artificial
  Mutation in BnaC.FAD2.b introduced by TALE nuclease pair BnFAD2_T01
caggatccatgggtgcaggtggaagaatgcaagtctatcctccctccagctcccccgaaaccaaaaccctcaaacgcgtcccctgcgagacaccacccttcactctcggagccctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcggcccctctactgggcctgccaaggctccgtcctaacgggcctctgggtcatagcccacgagtgcggccaccacgccttcagcgactac

SEQ ID NO: 569 - DNA, 346 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgcttcaaacgctccatccctcgctccttctcctacctcctcttcgacatcctcgtctcctcctccctctaccacctctccacagcctacttccctctcctcccccaccctctcccgtacctgccctctactgggcctgccaaggctgcgtcctaacgggcctctgggtcatagcccacgagtgcggccaccacgccatcagcgactac

SEQ ID NO: 570 - DNA, 340 bp, Artificial
  Mutation in BnaC.FAD2.b introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatcccacgctccttctcctcttcgacatcatcatctcctcctcggctcctccctctaccacctctccacagcctacttccctctcccttacctcgccctggcccctctactgggcctgccaaggctgcgtcctaacgggcctctgggtcatcgcccacgaatgcggccaccacgccttcagcgactac

SEQ ID NO: 571 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctcttctcccccaccctctcccttacccctctactgggcctgccaaggctgcgtcctaacgggcctctgggtcatcgcccacgaatgcggccaccacgccttcagcgactac

SEQ ID NO: 572 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgtcgtggcccctctactgggcctgccaaggctgcgtcctaacgggcctctgggtcatagcccacgagtgcggccaccacgccttcagcgactac

SEQ ID NO: 573 - DNA, 337 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccctctactgggcctgccaaggctgcgtcctaacgggcctctgggtcatcgcccacgaatgcggccaccacgccttcagcgactac

SEQ ID NO: 574 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgcctcctcctccctctaccacctctccacagcctacttccctctcctccccccccctctccctgacccctctactgggcctgccaaggctgcgtcctaacgggcctctgggtcatagcccacgagtgcggccaccacgccttcagcgactac

SEQ ID NO: 575 - DNA, 355 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctccttcctgacccctctactgggcctgccaaggctgcgtcctaacgggcctctgggtcatagcccacgagtgcggccaccacgccttcagcgactac

SEQ ID NO: 576 - DNA, 422 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgttgccggtgctgtgccaggcccacggcttgaccccggagcaggtggtggccatcgccagcaatattggtgctggcccctctactgggcctgccaaggctgcgtcctaaccggcgtctgggtcatcgcccacgagtgcggccaccacgccttcagcgactac

SEQ ID NO: 577 - DNA, 336 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttccctctcccttacctctggcccctctactgggcctgccaaggctgcgtcctaacgggcctctgggtcatcgcccacgaatgcggccaccacgccttcagcgactac

SEQ ID NO: 578 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttctctactgggcctgccagggctgcgtcctaaccggcgtctgggtcatagcccacgagtgcggccaccacgccttcagcgactac

SEQ ID NO: 579 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctccctcacccctggcccctctactgggcctgccaaggctgcgtcctaacgggcctctgggtcatcgcccacgaatgcggccaccacgccttcagcgactac

SEQ ID NO: 580 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttctctactgggcctgccagggctgcgtcctaaccggcgtctgggtcatagcccacgagtgcggccaccacgccttcagcgactac

SEQ ID NO: 581 - DNA, 355 bp, Artificial
  Mutation in BnaC.FAD2.b introduced by TALE nuclease pair BnFAD2_T01
caggatccattggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcgcctggcccctctactgggcctgccaaggctgcgtcctaacgggcctctgggtcatagcccacgagtgcggccaccacgccttcagcgactac

SEQ ID NO: 582 - DNA, 307 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctcaccctctctcctacctctctactgggcctgccagggctgcgtcctaaccggcgtctgggtcatagcccacgagtgcggccaccacgccttcagcgactac

SEQ ID NO: 583 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaaccggcgtctgggtcatagcccacgagtgcggccaccacgccttcagcgactac

SEQ ID NO: 584 - DNA, 351 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttccctctggcccctctactgggcctgccaaggctgcgtcctaacgggcctctgggtcatcgcccacgaatgcggccaccacgccttcagcgactac

SEQ ID NO: 585 - DNA, 331 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccctggcccctctactgggcctgccaaggctgcgtcctaacgggcgtctgggtcatagcccgcgagtgcggccaccacgccttcagcgactac

SEQ ID NO: 586 - DNA, 342 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttaccctctactgggcctgccaaggctgcgtcctaacgggcctctgggtcatcgcccacgaatgcggccaccacgccttcagcgactac

SEQ ID NO: 587 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctcttcgacatcctcgtctcctcctccctctaccacctctccacagcctacttccctctcctcccccaccctctcccttacctcgccgcatggcccctctactgggcctgccaaggctgcgtcctaacgggcctctgggtcatcgcccacgaatgcggccaccacgccttcagcgactac

SEQ ID NO: 588 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttcccttggcccctctactgggactgccaaggctgcgtcctaacgggcctctgggtcatcgcccacgaatgcggccaccacgccttcagcgactac

SEQ ID NO: 589 - DNA, 353 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacatctccacagcctacttccctctcctcccccaccctctcccttaccgcgctagcccctctactgggccggccaaggctgcgtcctaacgggcctcggggtcatcgcccacgaatgcggccaccacgccttcagcgactac

SEQ ID NO: 590 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccgcctctccacagcctacttccctctcctcccccaccctctcccttgccttggcccctctactgggcctgccaaggctgcgtcctaacgggcctctgggtcatcgcccacgaatgcggccaccacgccttcagcgactac

SEQ ID NO: 591 - DNA, 355 bp, Artificial
  Mutation in BnaC.FAD2.b introduced by TALE nuclease pair BnFAD2_T01
caggatccatgggtgcaggtggaagaatgcaagtgtctcctccctccaaaaagcctgaaaccgacaacatcaagcgcgtaccctgcgagacaccgcccttcactgtcggagaactcaagaaagcaatcccaccgcactgtttcaaacgctcaatccctcgctccttctcctacctcctcttcgacctcctcgtctcctcctccctctaccacctctccacagcctacttccctctcctcccccaccctctccctttcctcgcgcctggcccctctactgggcctgccaaggctgcgtcctaacgggcctctgggtcatcgcccacgagtgcggccaccacgccttcagcgactac

SEQ ID NO: 592 - DNA, 345 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctccctctaccacctctccacagcctacttccctctcctcccccaccctctcccttacccgcctggcccctctactgggcctgccaaggctgcgtcctaacgggcctctgggtcatcgcccacgaatgcggccaccacgccttcagcgactac

SEQ ID NO: 593 - DNA, 480 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccccctccccccccccccccccccccccccccccttccctccctgccactgccccccccctgccccggggccaagccgggggcctgccccagccccgccaccagccgctggaccgtctccagcgcctgcttgccgccatctggcccctctactgggcctgccaaggctgcgtcctaacgggcctctgggtcatcgcccacgaatgcggccaccacgccttcagcgactac

SEQ ID NO: 594 - DNA, 345 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctagcctctctactgggcctgccagggctgcgtcctaaccggcgtctgggtcatagcccacgagtgcggccaccacgccttcagcgactac

SEQ ID NO: 595 - DNA, 349 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttcccttggcccctctactgggcctgccaaggctgcgtcctaacgggcctctgggtcatcgcccacgagtgcggccaccacgccttcagcgactac

SEQ ID NO: 596 - DNA, 350 bp, Artificial
  Mutation in BnaC.FAD2.b introduced by TALE nuclease pair BnFAD2_T01
caggatccatgggtgcaggtggaagaatgcaagtctatcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctccccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 597 - DNA, 336 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctcctacctcctcttcgacatcctcgtctcctcctccctctaccacctctccacagccacgatggcggcaagcaggcgctggagcctggcccctctactgggcctgccaaggctgcgtcctaacgggcctctgggtcatagcccacgagtgcggccaccacgccttcagcgactac

SEQ ID NO: 598 - DNA, 348 bp, Artificial
  Mutation in BnaC.FAD2.b introduced by TALE nuclease pair BnFAD2_T01
caggatccatgggtgcaggtggaagaatgcaagtgcctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctccccccccctctccctcacctggcccctctactgggcctgccaaggctgcgtcctaacgggcctctgggtcatcgcccacgaatgcggccaccacgccttcagcgactac

SEQ ID NO: 599 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatcgcccacgaatgcggccaccacgcctcagcgactac

SEQ ID NO: 600 - DNA, 351 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctctggcccctctacggggcctgccaaggctgcgtcctaacgggcctctgggtcatagcccacgagtgcggccaccacgccttcagcgactac

SEQ ID NO: 601 - DNA, 351 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctcggctcctccctctaccacctctccacagcctacttccctctcctcccccaccctctccctggcccctctactgggcctgccaagggtgcgtcctaaccggcgtctgggtcatagcccacgagtgcggccaccacgccttcagcgactac

SEQ ID NO: 602 - DNA, 348 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgcttcaaacgctccatccctcgctccttctcctacctcctcttcgacatcctcgtctcctcctccctctaccacctctccacagcctacttccctctcctcccccaccctctcccttacctcgcccctctactgggcctgccaaggctgcgtcctaacgggcctctgggtcatcgcccacgaatgcggccaccacgccttcagcgactac

SEQ ID NO: 603 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctctacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 604 - DNA, 331 bp, Artificial
  Mutation in BnaC.FAD2.b introduced by TALE nuclease pair BnFAD2_T01
caggatccatgggtgcaggtgcaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccctggcccctctactgggcctgccaaggctgcgtcctaacgggcctctgggtcatcgcccacgaatgcggccaccacgccttcagcgactac

SEQ ID NO: 605 - DNA, 335 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctctactgggcctgccagggctgcgtcctaaccggcgtctgggtcatagcccacgagtgcggccaccacgccttcagcgactac

SEQ ID NO: 606 - DNA, 352 bp, Artificial
  Mutation in BnaC.FAD2.b introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctccctggcccctctactgggcctgccaaggctgcgtcctaacgggcctctgggtcatcgcccacgaatgcggccaccacgccttcagcgactac

SEQ ID NO: 607 - DNA, 348 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 608 - DNA, 403 bp, Artificial
  Mutation in BnaC.FAD2.b introduced by TALE nuclease pair BnFAD2_T01
caggatccatgggtgcaggtggaagaatgcaagtctatcctccctccagctcccacggaaccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctcccccaccctctcccttacctagcggatttgtcctactcaggagagcgttcaccgacaaacaacagataaaacgaaaggccctggcccctctactgggcctgccaaggctgcgtcctaacgggcctctgggtcatcgcccacgaatgcggccaccacgccttcagcgactac

SEQ ID NO: 609 - DNA, 335 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttaccttggcccctctactgggcctgccaaggctgcgtcctaacgggcctctgggtcatagcccacgagtgcggccaccacgccttcagcgactac

SEQ ID NO: 610 - DNA, 351 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttctggcctctctactgggcctgccaagggtgcgtcctaaccggcgtctgggtcatagcccacgagtgcggccaccacgccttcagcgactac

SEQ ID NO: 611 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcccacttggcctccctactgggcctgccaagggtgcgtcctaaccggcgtctgggtcatagcccacgagtgcggccaccacgccttcagcgactac

SEQ ID NO: 612 - DNA, 349 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttgccttggcccctctactgggcctgccaaggctgcgtcctaacgggcctctgggtcatcgcccacgaatgcggccaccacgccatcagcgactac

SEQ ID NO: 613 - DNA, 350 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgagtgcggccaccacgccttcagcgactac

SEQ ID NO: 614 - DNA, 348 bp, Artificial
  Mutation in BnaC.FAD2.b introduced by TALE nuclease pair BnFAD2_T01
caggatccatgggtgcaggtcgaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctctttgacatcctcgtctcctcctccctctaccacctctccacagcctacttccctctcctcccccaccctctcccttacctggcccctctactgggcctgccagggctgcgtcctaaccggcgtctgggtcatagcccacgagtgcggccaccacgccttcagcgactac

SEQ ID NO: 615 - DNA, 335 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagccacgatggcggcaagcaggcgctggagcctggcccctctactgggcctgccaaggctgcgtcctaacgggcctctgggtcatagcccacgagtgcggccaccacgccttcagcgactac

SEQ ID NO: 616 - DNA, 319 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctccccctctactgggcctgccaaggctgcgtcctaacgggcctctgggtcatcgcccacgaatgcggccaccacgccttcagcgactac

SEQ ID NO: 617 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttggcctctctactgggcctgccagggctgcgtcctaacgggcctctgggtcatagcccacgagtgcggccaccacgccttcagcgactac

SEQ ID NO: 618 - DNA, 350 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcatcccccaccctctcccttacctctggcccctctactgggcctgccaaggctgcgtcctaacgggcctctgggtcatcgcccacgagtgcggccaccacgccttcagcgactac

SEQ ID NO: 619 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 620 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctccctcacctctacggggcctgccaaggctgcgtcctaacgggcctctgggtcatagcccacgagtgcggccaccacgccttcagcgactac

SEQ ID NO: 621 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcgtagacctcaagaaagcaatcccacctcactgcttcaaacgctccatcccacgctccttctcctcttcgacatcatcatctcctcctcggctcctccctctaccacctctccacagcctacttccctctcccttacctcgccacctggcccctctactgggcctgccaaggctgcgtcctaacgggcctctgggtcatcgcccacgaatgcggccaccacgccttcagcgactac

SEQ ID NO: 622 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctgacccctctactgggcctgccaaggctgcgtcctaacgggcctctgggtcatagcccacgagtgcggccaccacgccttcagcgactac

SEQ ID NO: 623 - DNA, 349 bp, Artificial
  Mutation in BnaC.FAD2.b introduced by TALE nuclease pair BnFAD2_T01
caggatccatgggtgcaggtggaagaatgcaagtctctcctccctccagatcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 624 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccagggctgcgtcctaaccggcgtctgggtcatagcccacgagtgcggccaccacgccttcagcgactac

SEQ ID NO: 625 - DNA, 428 bp, Artificial
  Mutation in BnaC.FAD2.b introduced by TALE nuclease pair BnFAD2_T01
caggatccatggtgcaggtggaagaatgcaagtgtctcctccctccaagaagtctgaaaccgacaccatcaagcgcgtaccctgcgagacaccacccttcactctcggagacctcaagaaagcaatcccacctcactgcttcaaacgctcgatccctcgctccttctcctacctcctcttcgacatcctcgtctcctcctccctctaccacctctccacagcctacttccctctcctccctcaccctctctcctacgtcgggcgtccggcccgccaccctccgggccgtggcttcacaccatcgtggctggcgatggccaccacctgctccggggtcatggcctctctactgggccggccagggctgcgtcctaaccggcgtctgggtcatagcccacgagtgcggccaccacgccttcagcgactac

SEQ ID NO: 626 - DNA, 262 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttaccacgcccttcagcgactac

SEQ ID NO: 627 - DNA, 338 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctcttcgacatcatcatctcctcctcggctcctccctctaccacctctccacagcctacttccctctcccttacccgcctgacccctctactgggcctgccaaggctgcgtcctaacgggcctctgggtcatagcccacgagtgcggccaccacgccttcagcgactac

SEQ ID NO: 628 - DNA, 401 bp, Artificial
  Mutation in BnaC.FAD2.b introduced by TALE nuclease pair BnFAD2_T01
caggatccaagggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttgcctcgggcatccaagcagcaagcgcgttccgccgtgggtcgatgtttgactggcccctcaactgggcctgccaaggctgcgtcctaacgggcctctgggtcatagcccacgagtgcggccaccacgccttcagcgactac

SEQ ID NO: 629 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctactcccctctcctccctcaccctctctcctactggcctctctactgggcctgccaagggtgcgtcctaaccggcgtctgggtcatagcccacgagtgcggccaccacgccttcagcgactac

SEQ ID NO: 630 - DNA, 323 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttcgcctggcctctctactgggcctgccaagggtgcgtcctaaccggcgtctgggtcatagcccacgagtgcggccaccacgccttcagcgactac

SEQ ID NO: 631 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctcccacaccctctctcctacttcggcctctctactgggcctgccaagggtgcgtcctaaccggcgtctgggtcatagcccacgaatgcggccaccacgccttcagcgactac

SEQ ID NO: 632 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcctggccatctactgggcctgccaaggctgcgtcctaacgggcctctgggtcatagcccacgagtgcggccaccacgccttcagcgactac

SEQ ID NO: 633 - DNA, 348 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcccctctactgggcctgccaaggctgcgtcctaacgggcctctgggtcatcgcccacgaatgcggccaccacgccttcagcgactac

SEQ ID NO: 634 - DNA, 313 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctcaccctctctcctacttctggcctctctactgggcctgccagggctgcgtcctaaccggcgtctgggtcatagcccacgagtgcggccaccacgccttcagcgactac

SEQ ID NO: 635 - DNA, 347 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctgcccctctactgggcctgccaaggctgcgtcctaacgggcctctgggtcatagcccacgagtgcggccaccacgccttcagcgactac

SEQ ID NO: 636 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccccaccctctcccttacctcgccctggcccctctactgggcctgccaaggctgcgtcctaacgggcctctgggtcatcgcccacgaatgcggccaccacgccttcagcgactac

SEQ ID NO: 637 - DNA, 340 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctccctctactgggcctgccaaggctgcgtcctaacgggcctctgggtcatcgcccacgaatgcggccaccacgccttcagcgactac

SEQ ID NO: 638 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttcccttggcccctctactgggcctgccaaggctgcgtcctaacgggcctctgggtcatagcccacgagtgcggccaccacgccttcagcgactac

SEQ ID NO: 639 - DNA, 260 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcccttaccacgccttcagcgactac

SEQ ID NO: 640 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagccacgatggcggcaagcaggcgctggagcctggcccctctactgggcctgccaaggctgcgtcctaacgggcctctgggtcatcgcccacgaatgcggccaccacgccttcagcgactac

SEQ ID NO: 641 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccgctggcccctctactgggcctgccaagggtgcgtcctaaccggcgtctgggtcatagcccacgagtgcggccaccacgccttcagcgactac

SEQ ID NO: 642 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgtcaaggctgcgtcctaacgggcctctgtgtcatcgcccacgaatgcggccaccacgccttcagcgactac

SEQ ID NO: 643 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcatcctccctctaccacctctccacagcctacttccctctcctccccccccctctcccttacctcccctctactgggcctgccaaggctgcgtcctaacgggcctctgggtcatcgcccacgaatgcggccaccacgccttcagcgactac

SEQ ID NO: 644 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 645 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 646 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctgtgggtcatagcccacgagtgcggccaccacgccttcagcgactac

SEQ ID NO: 647 - DNA, 380 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctactccacagtggtccggcgcacgcgctctggaggcctgcctctctactgggcctgccaaggctgcgtcctaacgggcctctgggtcatagcccacgagtgcggccaccacgccttcagcgactac

SEQ ID NO: 648 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctctggcccctctactgggcctgccaaggctgcgtcctaacgggcctctgggtcatagcccacgagtgcggccaccacgccttcagcgactac

SEQ ID NO: 649 - DNA, 319 bp, Artificial
  Mutation in BnaC.FAD2.b introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactcacggagacctcaagaaagcaatcccacctcactgcttcaaacgctccatcccacgctccttctcctcttcgacatcctcgtctcctcctccctctaccacctctccacagcctacttccctctcctccccctctactgggcctgccaaggctgcgtcctaacgggcctctgggtcatcgcccacgaatgcggccaccacgccttcagcgactac

SEQ ID NO: 650 - DNA, 340 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctctccctccctctactgggcctgccaaggctgcgtcctaacgggcctctgggtcatagcccacgagtgcggccaccacgccttcagcgactac

SEQ ID NO: 651 - DNA, 356 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgccgcctggcctctctactgggcctgccaaggctgcgtcctaacgggcctctgggtcatcgcccacgaatgcggccaccacgccttcagcgactac

SEQ ID NO: 652 - DNA, 260 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcccttaccacgccttcagcgactcc

SEQ ID NO: 653 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagccacgatggcggcaagcaggcgctggagcctggccccgctacggggcctgccaaggctgcgtcctaacgggcctctgggtcatagcccacgagtgcggccaccacgccttcagcgactac

SEQ ID NO: 654 - DNA, 261 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccacctcactgcttcaaacgctccatcccacgctccttctcctcttcgacatcatcatctcctcctcggctcctccctctaccacctctccacagcctacttccctctcccttacctcgccttcagcgactac

SEQ ID NO: 655 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacgccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccctggcccctctactgggcctgccaaggctgcgtcctaacgggcctctgggtcatcgcccacgaatgcggccaccacgccttcagcgactac

SEQ ID NO: 656 - DNA, 340 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttacctccgcctggcccctctactgggcctgccaaggctgcgtcctaacgggcctctgggtcatcgcccacgaatgcggccaccacgccttcagcgactac

SEQ ID NO: 657 - DNA, 351 bp, Artificial
  Mutation in BnaC.FAD2.b introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagaactcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcggcctctctactgggcctgccaaggctgcgtcctaacgggcctctgggtcatcgcccacgaatgcggccaccacgccttcagcgactac

SEQ ID NO: 658 - DNA, 424 bp, Artificial
  Mutation in BnaC.FAD2.b introduced by TALE nuclease pair BnFAD2_T01
caggatccatgggtgcaggtggaagaatgcaagtctctcctccctccagctcccccgaaaacaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctactgggccaggcccacggcttgaccccggagcaggtgggggccatcgccagccacgatggcggcaagcaggcgctggactggcctctctactgggcctgccagggccgcgtcctaaccggcgtctgggtcatagcccacgagtgcggccaccacgccttcagcgactac

SEQ ID NO: 659 - DNA, 394 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctaagggcgagatccggtgcagattatttggattgagagtgaatattgcccctctactgggcctgccaaggctgcgtcctaaccggcgtctgggtcatagcccacgagtgcggccaccacgccttcagcgactac

SEQ ID NO: 660 - DNA, 356 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttctacatcctcgtctcctcctccctctaccacctctccacagcctacttccctctcctcccccaccctctctcctacttcgccgcctggcctctctactgggcctgccagggctgcgtcctaaccggcgtctgggtcatagcccacgagtgcggccaccacgccttcagcgactac

SEQ ID NO: 661 - DNA, 410 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctagcggatttgtcctactcaggagagcgttcaccgacaaacaacagataaaacgaaaggccctggcccctctactgggcctgccaaggctgcgtcctaacgggcctctgggtcatagcccacgagtgcggccaccacgccttcagcgactac

SEQ ID NO: 662 - DNA, 355 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgtcgtggcccctctactgggcctgccaaggctgcgtcctaacgggcctctgggtcatcgcccacgaatgcggccaccacgccttcagcgactac

SEQ ID NO: 663 - DNA, 348 bp, Artificial
  Mutation in BnaC.FAD2.b introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctccccacagcctacttccctctcctcccccaccctctcccttgcctcgcccctctactgggcctgccaaggctgcgtcctaacgggcctctgggtcatcgcccacgaatgcggccaccacgccttcagcgactac

SEQ ID NO: 664 - DNA, 429 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactacttcaaacgctccatccctcgctccttctcctacctcctcttcgacatcctcgtctcctcctccctctaccacctctccacagcctacttccctctcctcccccaccctctcccttccctccccagcggctgttgccggtgctgtgccaggcccacggcttgaccccggagcaggtggtggccatcgccagccacgatggtggcccctctactgggcctgccaaggctgcgtcctaacgggcctctgggtcatcgcccacgaatgcggccaccacgccttcagcgactac

SEQ ID NO: 665 - DNA, 358 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctcgtctggcccctctactgggcctgccaaggctgcgtcctaacgggcctctgggtcatcgcccacgaatgcggccaccacgccttcagcgactac

SEQ ID NO: 666 - DNA, 351 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcctcgctccttctcctacctcctcttcgacatcctcgtctcctcctccctctaccacctctccacagcctacttccctctcctcccccaccctctcccttacctcgccggcccctctactgggcctgccaaggctgcgtcctaacgggcctctgggtcatcgcccacgaatgcggccaccacgccttcagcgactac

SEQ ID NO: 667 - DNA, 336 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctgggcctgccaaggctgcgtcctaacgggcctctgggtcatcgcccacgaatgcggccaccacgccttcagcgactac

SEQ ID NO: 668 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacccctggcccctctactgggcctgccaaggctgcgtcctaacgggcctctgggtcatcgccctcgaatgcggccaccacgccttcagcgactac

SEQ ID NO: 669 - DNA, 358 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatccttgtctcctcctccctctaccacctctccacagcatacttccctctcctcccccaccctctcccttacctcgcctcgtctggcccctctactgggcctgccaaggctgcgtcctaacgggcctctgggtcatcgcccacgaatgcggccaccacgccttcagcgactac

SEQ ID NO: 670 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctccatccctcgctccttctcctacctcctcttcgacatcctcgtctcctcctccctctaccacctctccacagcctacttccctctcctccccccccctctcccttacctctggcccctctactgggcctgccaaggctgcgtcctaacgggcctctgggtcatagcccacgagtgcggccaccacgccttcagcgactac

SEQ ID NO: 671 - DNA, 331 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagacctcaagaaagcaatcccacctcactgcttcaaacgctccatccctcgctccttctcctacctcctcttcgacatcctcgtctcctcctccctctaccacctctccacagcctacttccctctcctccctggcccctctactgggcctgccaaggctgcgtcctaacgggcctctgggtcatagcccacgagtgcggccaccacgccttcagcgactac

SEQ ID NO: 672 - DNA, 373 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaaacaatcccacctcactgcttcaaacgctccatccctcgctccttctcctacctcctcttcgacatcctcgtctcctcctccctctaccacctctccacagcctacttccctctcctcccccaccctctcccttacctctccagcgcctgcttgccgccatcgtgcccctctactgggcctgccaaggctgcgtcctaacgggcctctgggtcatcgcccacgaatgcggccaccacgccttcagcgactac

SEQ ID NO: 673 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctggcctctctactgggcctgccagggctgcgtcctaaccggcgtctgggtcatagcccacgagtgcggccaccacgccttcagcgactac

SEQ ID NO: 674 - DNA, 410 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccccagcggatttgtcctactcaggagagcgttcaccgacaaacaacagataaaacgaaaggccctggcccctctactgggcctgccaaggctgcgtcctaacgggcctctgggtcatcgccctcgagtgcggccaccacgccttcagcgactac

SEQ ID NO: 675 - DNA, 353 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgctggcccctctactgggcctgccaaggctgcgtcctaacgggcctctgggtcatcgcccacgaatgcggccaccacgccttcagcgactac

SEQ ID NO: 676 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 677 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctcttcgacatcctcgtctcctcctccctctaccacctctccacagcctacttccctctcctcccccaccctctcccttgcctctggcccctctactgggcctgccaaggctgcgtcctaacgggcctctgggtcatcgcccacgaatgcggccaccacgccttcagcgactac

SEQ ID NO: 678 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctactgggcctgccaaggctgcgtcctaacgggcctctgggtcatagcccacgagtgcggccaccacgccttcagcgactac

SEQ ID NO: 679 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctcccccaccctctcccttacctcgccgcctggcccctctactgggcctgccaaggctgcgtcctaacgggcctctgggtcatagcccacgagtgcggccaccacgccttcagcgactac

SEQ ID NO: 680 - DNA, 359 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcggcgggtctggcctctctactaggcctgccagggctgcgtcctaaccggcgtctgggtcatagcccacgagtgcggccaccacgccttcagcgactac

SEQ ID NO: 681 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttgcctggcccctctactgggcctgccaaggctgcgtcctaacgggcctctgggtcatcgcccgcgaatgcggccaccacgccttcagcgactac

SEQ ID NO: 682 - DNA, 349 bp, Artificial
  Mutation in BnaC.FAD2.b introduced by TALE nuclease pair BnFAD2_T01
caggatccatgggtgcaggtggaagaatgcaagtctctcctccctccaactcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttcccttggcccctctactgggcctgccaaggctgcgtcctaacgggcctctgggtcatcgcccacgaatgcggccaccacgccttcagcgactac

SEQ ID NO: 683 - DNA, 332 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttacctcccctctactgggcctgccaaggctgcgtcctaacgggcctctgggtcatcgcccacgaatgcggccaccacgccttcagcgactac

SEQ ID NO: 684 - DNA, 260 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcccttaccacgccttcagcgactac

SEQ ID NO: 685 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggcggcgtcctaacgggcctctgggtcatagcccacgagtgcggccaccacgccttcagcgactac

SEQ ID NO: 686 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacatcctaaaaggcgtcccctgcgagacaccaccattcaccctcggagacctcaagaaagcaatcccacctcactgcttcagacgctccatcccacgctccttctcctcttcaacatcctcgtctcctcctccctctacctcctcaccacagcctacttccctctcctcccccaccctctcccttccctctggcccctctactgggcctgccaaggctgcgtcctaacgggcctctgggtcatcgcccacgaatgcggccaccacgccttcagcgactac

SEQ ID NO: 687 - DNA, 326 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccctctactgggcctgccaaggctgcgtcctaacgggcctctgggtcatagcccacgagtgcggccaccacgccttcagcgactac

SEQ ID NO: 688 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctcccccttacctcccctctactgggcctgccaaggctgcgtcctaacgggcctctgggtcatcgcccacgaatgcggccaccacgccttcagcgactac

SEQ ID NO: 689 - DNA, 351 bp, Artificial
  Mutation in BnaC.FAD2.b introduced by TALE nuclease pair BnFAD2_T01
cggatccatgggtgcaggtagaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgccggcccctctactgggcctgccaaggctgcgtcctaacgggcctctgggtcatcgcccacgaatgcggccaccacgccttcagcgactac

SEQ ID NO: 690 - DNA, 337 bp, Artificial
  Mutation in BnaC.FAD2.b introduced by TALE nuclease pair BnFAD2_T01
caggatccatgggtgcaggtggaagaatgcaagtctctcctccctccagctccaccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccctctactgggcctgccaaggctgcgtcctaacgggcctctgggtcatcgcccacgaatgcggccaccacgccttcagcgactac

SEQ ID NO: 691 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttggcctctctactgggcctgccagggctgcgtcctaacgggcctctgggtcatagcccacgagtgcggccaccacgccttcagcgactac

SEQ ID NO: 692 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccctggcccctctactgggcctgccaaggctgcgtcctaacgggcctctgggtcatctcccacgaatgcggccaccacgccttcagcgactac

SEQ ID NO: 693 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 694 - DNA, 335 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccacctcactgcttcaaacgctccatcccacgctccttctcctcttcgacatcatcatctcctcctcggctcctccctctaccacctctccacagcctacttccctctcccttaccttggcccctctactgggcctgccaaggctgcgtcctaacgggcctctgggtcatcgcccacgaatgcggccaccacgccttcagcgactac

SEQ ID NO: 695 - DNA, 356 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttccctctcctcccccccccgctccctgacctcctccctggcccctctactgagcatgccatggcagcgtcctaacgggccactgggtcatctcccacgagtgcggccaccacgccatcagcgactac

SEQ ID NO: 696 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaacaccctcaaacgcgtcccctgcgagacaccaccattcactctcggagacctcaagaaagcaatcccacctcactgcttcaaacgctccatccctcgctccttctcctacctcctcttcgtcctcctcgtctcctcctccctccacctcccctccacctcctacttccccctcccccccccaccccccccttacccctggcccctctactgggcctgccaaggctgcgtcctaacgggcctctgggtcatcgcccacgaatgcggccaccacgccttcagcgactac

SEQ ID NO: 697 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccatctcccttaccttggcccctctactgggcctgccaaggctgcgtcctaacgggcctctgggtcatcgcccacgaatgcggccaccacgccttcagcgactac

SEQ ID NO: 698 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctcccctctactgggcctgccaaggctgcgtcctaacgggcctctgggtcatcgcccacgaatgcggccaccacgccttcagcgactac

SEQ ID NO: 699 - DNA, 349 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 700 - DNA, 356 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcatcatctcctcctcggctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 701 - DNA, 348 bp, Artificial
  Mutation in BnaC.FAD2.b introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcccctctactgggcctgccaaggctgcgtcctaacgggcctctgggtcatagcccacgagtgcggccaccacgccttcagcgactac

SEQ ID NO: 702 - DNA, 261 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccgcctctccacagcctacttccctctcccttaccacgccttcagcgactac

SEQ ID NO: 703 - DNA, 429 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttccccctccagcggctgttgccggtgctgtgccaggcccacggcttgacccctcagcaggtggtggccatcgccagccacgatggtggcccctctactgggcctgccaaggctgcgtcctaacgggcctctgggtcatagcccacgagtgcggccaccacgccttcagcgactac

SEQ ID NO: 704 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctctggcccctctactgggcctgccaaggctgcgtcctaacgggcctctgggtcatcgcccacgaatgcggccaccacgccttcagcgactac

SEQ ID NO: 705 - DNA, 324 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttcgcctggcctctctactgggcctgccagggctgcgtcctaaccggcgtctgggtcatagcccacgagtgcggccaccacgccttcagcgactac

SEQ ID NO: 706 - DNA, 431 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctgcttttgccggtgctgtgccaggcgctcggtcgttcggctgcggcgggcggtatcagctcactcaaaggcggtaatacggttatcctggcctctctactgggcctgccaaggctgcgtcctaacgggcctctgggtcatcgcccacgaatgcggccaccacgccttcagcgactac

SEQ ID NO: 707 - DNA, 412 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctgcccccgctggagacggtccagcggctgttgccggtgctgggccaggcccacggcttgaccccggagctggcccctctactgggcctgccaaggctgcgtcctaacgggcctctgggtcatagcccacgagtgcggccaccacgccttcagcgactac

SEQ ID NO: 708 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgctggcccctctactgggcctgccaaggctgcgtcctaacgggcctctgggtcatagcccgcgagtgcggccaccacgccttcagcgactac

SEQ ID NO: 709 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcgcagacctcaagaaagcaatcccacctcactgcttcaaacgctccatcccacgctccttctcctacctcctcttcgacatcctcgtctcctcctccctctaccacctctccacagcctacttccctctcctccccccccctctcccttccctcgcccctctactgggcctgccaaggctgcgtcctaacgggcctctgggtcatcgccctcgaatgcggccaccacgccttcagcgactac

SEQ ID NO: 710 - DNA, 337 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctcgcccctctactgggcctgccaaggctgcgtcctaacgggcctctgggtcatagcccacgagtgcggccaccacgccttcagcgactac

SEQ ID NO: 711 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 712 - DNA, 340 bp, Artificial
  Mutation in BnaC.FAD2.b introduced by TALE nuclease pair BnFAD2_T01
caggatccatgggtgcaggtggaagaatgcaagtgtctcctcactccaaaaagtctgaaaccgacaccatcaagcgcgtaccctgcgagacaccgcccttcactgtcggagaactcaagaaagcaatcccacctcactgcttcaaacgctccatcccacgctccttctcctcttcgacatcatcatctcctcctcggctcctccctctaccacctctccacagcctacttccctcccccaccctctcgcctggcccctctactgggcctgccaaggctgcgtcctaacgggcctctgggtcatcgcccacgagtgcggccaccacgccttcagcgactac

SEQ ID NO: 713 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctccctctaccacctctccacagcctacttccctctcctccctcaccctctctcctacttggcctctctactgggcctgccagggctgcgtcctaaccggcgtctgggtcatagcccacgagtgcggccaccacgccttcagcgactac

SEQ ID NO: 714 - DNA, 351 bp, Artificial
  Mutation in BnaC.FAD2.b introduced by TALE nuclease pair BnFAD2_T01
gcaggatccatgggtgcagttggaagaatgcaagtgtctcctccctccaagaagtctgaaaccgacaccatcaagcgcgtaccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctctggcccctctactgggcctgccaaggctgcgtcctaacgggcctctgggtcatcgcccacgaatgcggccaccacgccttcagcgactac

SEQ ID NO: 715 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctccctcctcctctctactgggcccgccagggctgcgtcctaaccggcgtctgggtcatagcccacgagtgcggccaccacgccttcagcgactac

SEQ ID NO: 716 - DNA, 345 bp, Artificial
  Mutation in BnaC.FAD2.b introduced by TALE nuclease pair BnFAD2_T01
caggatccatgggtgcaggtggaagaatgcaagtatctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctccaccacctctccacagcctacttccctctcctccccccccctctcccttaccccccactactgggcctgccaaggctgcgtcctaacgggcctctgggtcatcgcccacgaatgcggccaccacgccttcagcgactac

SEQ ID NO: 717 - DNA, 261 bp, Artificial
  Mutation in BnaC.FAD2.b introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttaccacgccttcagcgactac

SEQ ID NO: 718 - DNA, 381 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgctcgccgcagccgaacgaccgagcgcagcgtggcccctctactgggcctgccaagggtgcgtcctaacgggcctctgggtcatagcccacgagtgcggccaccacgccttcagcgactac

SEQ ID NO: 719 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccagggctgcgtcctaaccggcgtctgggtcatagcccacgagtgcggccaccacgccttcagcgactac

SEQ ID NO: 720 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttgcctctctactgggcctgccagggctgcgtcctaacgggcctctgggtcatagcccacgagtgcggccaccacgccttcagcgactac

SEQ ID NO: 721 - DNA, 346 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttatggcccctctactgggcctgccaaggctgcgtcctaacgggcctctgggtcatcgcccacgaatgcggccaccacgccttcagcgactac

SEQ ID NO: 722 - DNA, 345 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctcccccaccctctcccttacctcgccggcccctctactgggcctgccaaggctgcgtcctaacgggcctctgggtcatcgcccacgaatgcggccaccacgccttcagcgactac

SEQ ID NO: 723 - DNA, 339 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctggcctctctactgggcctgccaagggtgcgtcctaacgggcctctgggtcatagcccacgagtgcggccaccacgccttcagcgactac

SEQ ID NO: 724 - DNA, 381 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgctcgccgcagccgaacgaccgagcgcagcgtggcccctctactgggcctgccaaggctgcgtcctaacgggcctctgggtcatcgcccacgaatgcggccaccacgccttcagcgactac

SEQ ID NO: 725 - DNA, 350 bp, Artificial
  Mutation in BnaC.FAD2.b introduced by TALE nuclease pair BnFAD2_T01
caggatccatgggtgcaggtggaagaatgcaagtctctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 726 - DNA, 324 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctccctctaccacctctccacagcctacttccctctcctccctcaccctctctccgggcctgccagggctgcgtcctaaccggcgtctgggtcatagcccacgagtgcggccaccacgccttcagcgactac

SEQ ID NO: 727 - DNA, 315 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctcaccctctctcctacttcgctggcctctctactgggcctgccagggctgcgtcctaaccggcgtctgggtcatagcccacgagtgcggccaccacgccttcagcgactac

SEQ ID NO: 728 - DNA, 450 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctcccccttgcctcggccttgatcatctcgccgccgatcaggagctcctccacggacagcacggcgccgtttcgttttatttgatgcctggcagttccctactctcgcgttcgaatacatctagatccaagcctgccaaggctgcgtcctaacgggcctctgggtcatcgcccacgaatgcggccaccacgcctagcgactac

SEQ ID NO: 729 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatagcccacgagtgcggccaccacgccttcagcgactac

SEQ ID NO: 730 - DNA, 348 bp, Artificial
  Mutation in BnaC.FAD2.b introduced by TALE nuclease pair BnFAD2_T01
caggatccatgggtgaaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctcccccttacctggcccctctactgggcctgccaaggctgcgtcctaacgggcctctgggtcatcgcccacgaatgcggccaccacgccttcagcgactac

SEQ ID NO: 731 - DNA, 339 bp, Artificial
  Mutation in BnaC.FAD2.b introduced by TALE nuclease pair BnFAD2_T01
caggatccatgggtgcaggtggaagaatgcaagtctctcctccctccagctccaccggaaccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctcccccaccctctcccttatggcccctctactgggcctgccaaggctgcgtcctaacgggcctctgggtcatagcccacgagtgcggccaccacgccttcagcgactac

SEQ ID NO: 732 - DNA, 331 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctggcccctctactgggcctgccaaggctgcgtcctaacgggcctctgggtcatcgcccacgaatgcggccaccacgccttcagcgactac

SEQ ID NO: 733 - DNA, 312 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctgggtctgccaaggctgcgtcctaacgggcctctgggtcatcgcccacgaatgcggccaccacgccttcagcgactac

SEQ ID NO: 734 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctactggcctctctactgggcctgccaagggtgcgtcctaacgggcctctgggtcatcgcccacgaatgcggccaccacgccttcagcgactac

SEQ ID NO: 735 - DNA, 326 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccctctactgggcctgccaaggctgcgtcctaacgggcctctgggtcatcgcccacgaatgcggccaccacgccttcagcgactac

SEQ ID NO: 736 - DNA, 342 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactctcggagacctcaagaaagcaatcccacctcactgcttcaaacgctccatccctcgctccttctcctacctcctcttcgacatcctcgtctcctcctccctctaccacctctccacagccacgatggcggcaagcaggcgctggagcctggcccctctactgggcctgccaaggctgcgtcctaacgggcctctgggtcatcgcccacgaatgcggccaccacgccttcagcgactac

SEQ ID NO: 737 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctcccccaccctctcccttacctctggcccctctactgggcctgccaaggctgcgtcctaacaggcctctgggtcatcgcccacgaatgcggccaccacgccttcagcgactac

SEQ ID NO: 738 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatagcccacgagtgcggccaccacgccttcagcgactac

SEQ ID NO: 739 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacccctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 740 - DNA, 401 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttgcctcgggcatccaagcagcaagcgcgttacgccgtgggtcgatgtttgactggcccctctactgggcctgccaaggctgcgtcctaacgggcctctgggtcatcgcccacgaatgcggccaccacgccttcagcgactac

SEQ ID NO: 741 - DNA, 338 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatcccacgctccttctcctcttcgacatcatcatctcctcctcggctcctccctctaccacctctccacagcctacttccctctcccttacctcgccggcccctctactgggcctgccaaggctgcgtcctaacgggcctctgggtcatcgcccacgagtgcggccaccacgccttcagcgactac

SEQ ID NO: 742 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcccccctcaccctctctcctactggcctctctactgggcctgccagggctgcgtcctaaccggcgtctgtgtcatagcccacgagtgcggccaccacgccttcagcgactac

SEQ ID NO: 743 - DNA, 312 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacacccccaaacgcgtcccctgcgagacaccaccattcactctcggagacctcaagaaagcaatcccacctcactgcttcaaacgctccatcccacgctccttctcctattcgacctcatcatctcctcctcggctcctccctcaccccctctcccacttggcctctctactgggcctgccaagggtgcgtcctaaccggcgtctgggtcatagcccacgagtgcggccaccacgccttcagcgactac

SEQ ID NO: 744 - DNA, 387 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacaacggctgataggatcccccaatccctttttcactgcatctggcccctctactgggcctgccaaggctgcgtcctaacgggcctctgggtcatcgcccacgagtgcggccaccacgccttcagcgactac

SEQ ID NO: 745 - DNA, 346 bp, Artificial
  Mutation in BnaC.FAD2.b introduced by TALE nuclease pair BnFAD2_T01
caggatccatgggtgcaggtggcagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttatggcccctctactgggcctgccaaggctgcgtcctaacgggcctctgggtcatcgcccacgaatgcggccaccacgccttcagcgactac

SEQ ID NO: 746 - DNA, 418 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttagccgtagttaggccaccactccaagaactctgtagcaccgcctacatacctcgctctgctaatcctgttacctggcccctctactgggcctgccaaggctgcgtcctaacgggcctctgggtcatcgcccacgaatgcggccaccacgccttcagcgactac

SEQ ID NO: 747 - DNA, 350 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctccccccccctctcccttacctctggcccctctactgggcctgccaaggctgcgtcctaacgggcctctgggtcatcgcccacgaatgcggccaccacgccttcagcgactac

SEQ ID NO: 748 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctccctcaccctctctcctacttcgccttggcctctctactgggcctgccagggctgcgtcctaaccggcgtctgggtcatagcccacgagtgcggccaccacgccttcagcgactac

SEQ ID NO: 749 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttcccttggcccctctactgggcctgccaaggctgcgtcctaacgggcctctgggtcatagcccacgagtgcggccaccacgccttcagcgactac

SEQ ID NO: 750 - DNA, 355 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcgcctggcccctctactgggcctgccaaggctgcgtcctaacgggcctctgggtcatcgcccacgaatgcggccaccacgccttcagcgactac

SEQ ID NO: 751 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccattcccttggcccctctactgggcctgccaaggctgcgtcctaacgggcctctgggtcatagcccacgagtgcggccaccacgccttcagcgactac

SEQ ID NO: 752 - DNA, 311 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctcaccctctctcctactttcctctctactgggcctgccagggctgcgtcctaacgggcctctgggtcatagcccacgagtgcggccaccacgccttcagcgactac

SEQ ID NO: 753 - DNA, 336 bp, Artificial
  Mutation in BnaC.FAD2.b introduced by TALE nuclease pair BnFAD2_T01
caggatccatgggtgcaggtggaagaatgcaagtctctcctccctccagctaccccggaaccaacaccatcaaacgcgtcccctgcgagacaccaccattcactctcggagacctcaagaaagcaatcccacctcactgcttcaaacgctccatccctcgctccttctcctacctccacttcgacatcctcgtctccccctccctctaccacctctccacagcctacttccctcgcctcccccacccgctccctcaccggggcctgccaaggctgcgtcctaacgggcctctgggtcatcgcccacgaatgcggccaccacgccttcagcgactac

SEQ ID NO: 754 - DNA, 326 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttcgcccctggcctctctactgggcctgccaagggtgcgtcctaaccggcgtctgggtcatagcccacgagtgcggccaccacgccttcagcgactac

SEQ ID NO: 755 - DNA, 348 bp, Artificial
  Mutation in BnaC.FAD2.b introduced by TALE nuclease pair BnFAD2_T01
caggatccatggttgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctggcccctctactgggcctgccaaggctgcgtcctaacgggcctctgggtcatcgcccacgaatgcggccaccacgccttcagcgactac

SEQ ID NO: 756 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttctggcctctctactgggcctgccagggctgcgtcctaaccggcgtctgggtcatagcccacgagtgcggccaccacgccttcagcgactac

SEQ ID NO: 757 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctccttccctctcctcccccaccctctcccttaccttggcccctctactgggcctgccaaggctgcgtcctaacgggcctctgggtcatcgcccacgaatgcggccaccacgccttcagcgactac

SEQ ID NO: 758 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttccctctcctcccccacccgcctggcccctctactgggcctgccaaggctgcgtcctaaccggcgtctgggtcatagcccacgagtgcggccaccacgccttcagcgactac

SEQ ID NO: 759 - DNA, 337 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctcgcccctctactgggcctgccaaggctgcgtcctaacgggcctctgggtcatcgcccacgaatgcggccaccacgccttcagcgactac

SEQ ID NO: 760 - DNA, 356 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccacctggcccctctactgggcctgccaaggctgcgtcctaacgggcctctgggtcatcgcccacgaatgcggccaccacgccttcagcgactac

SEQ ID NO: 761 - DNA, 349 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 762 - DNA, 381 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaaacgcgtcccctgcgagacaccacccttcactctcggagacctcaagaaagcaatcccacctcactgcttcaaacgctccatccctcgctccttctcctacctcctcttcgacatccacgtctcctcctccctctaccacctctccacagcctacttccctctcctcccccaccctctcccttccctcgctcgccgcagccgaacgaccgagcgcagcgtggcccctctactgggcctgccaaggctgcgtcctaacgggcctctgggtcatcgcccacgaatgcggccaccacgccttcagcgactac

SEQ ID NO: 763 - DNA, 312 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctcaccctctctcctacttggcctctctactgggcctgccaagggtgcgtcctaaccggcgtctgggtcatagcccacgagtgcggccaccacgccttcagcgactac

SEQ ID NO: 764 - DNA, 348 bp, Artificial
  Mutation in BnaC.FAD2.b introduced by TALE nuclease pair BnFAD2_T01
caggatccatgggtgcaggtggcagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctctccctctctcctccttgcctctctactgggcctgccaggggtgcgtcctaaccggcgtctgggtcatagcccacgagtgcggccaccacgccttcagcgactac

SEQ ID NO: 765 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggccggccaaggctgcgtcctaaccggcgtctgggtcatagcccacgagtgcggccaccacgccttcagcgactac

SEQ ID NO: 766 - DNA, 355 bp, Artificial
  Mutation in BnaC.FAD2.b introduced by TALE nuclease pair BnFAD2_T01
caggatccatgggtgcaggtggaagaatgcaagtctctcctccctccagctcccccggaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccccctctccacagcctacttccctctcctccccccccccctcccttacctccgcctggcccctctactgggcctgccaaggctgcgtcctaacgggcctctgggtcatcgcccacgaatgcggccaccacgccttcagcgactac

SEQ ID NO: 767 - DNA, 358 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttccctcgcctcgtctggcccctctactgggcctgccaaggctgcgtcctaacgggcctctgggtcatagcccacgagtgcggccaccacgccttcagcgactac

SEQ ID NO: 768 - DNA, 344 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcgcctggcccctctactgggcctgccaaggctgcgtcctaacgggcctctgggtcatcgcccacgaatgcggccaccacgccttcagcgactac

SEQ ID NO: 769 - DNA, 348 bp, Artificial
  Mutation in BnaC.FAD2.b introduced by TALE nuclease pair BnFAD2_T01
caggatccatgggtgcaggtggaagaatgcaagtctctcctccctccagctccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 770 - DNA, 352 bp, Artificial
  Mutation in BnaC.FAD2.b introduced by TALE nuclease pair BnFAD2_T01
caggatccatgggtgcaggtggcagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcctcccccaccctctccctgacctcgctggcccctctactgggcctgccaaggctgcgtcctaacgggcctctgggtcatcgcccacgaatgcggccaccacgccttcagcgactac

SEQ ID NO: 771 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctcccacctctccacagcctacttccctctcccttacctcgccgcctggcccctctactgggcctgccaagggtgcgtcctaacgggcctctgggtcatcgcccacgaatgcggccaccacgccttcagcgactac

SEQ ID NO: 772 - DNA, 349 bp, Artificial
  Mutation in BnaC.FAD2.b introduced by TALE nuclease pair BnFAD2_T01
caggatccatgggtgcagctggaagaatgcaagtctctcctccctccagctcccccggaaccaacaccctcaaacgcgtcccctgcgagacaccaccattcactctcggagaactcaagaaagcaatcccaccgcactgtttcaaacgctcgatccctcgctctttctcctacctcatctgggacatcatcatagcctcctccctctaccacctctccacagcctacttccctctcctcccccaccctctcccttaccttggcccctctactgggcctgccaaggctgcgtcctaacgggcctctgggtcatagcccacgagtgcggccaccacgccttcagcgactac

SEQ ID NO: 773 - DNA, 331 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctggcccctctactgggcctgccaaggctgcgtcctaacgggcctctgggtcatcgcccacgaaggcggccaccacgccggcagcgactac

SEQ ID NO: 774 - DNA, 344 bp, Artificial
  Mutation in BnaC.FAD2.b introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccacctcactgcctcaaacgctccatccctcgctccttctcctacctcctcttcgacatcctcgtctcctcctccctctaccacctctccacagcctacttccctctcctcccccaccctctcccttggcccctctactgggcctgccaaggctgcgtcctaacgggcctctgggtcatcgcccacgaatgcggccaccacgccttcagcgactac

SEQ ID NO: 775 - DNA, 399 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctcctcccccaccctctcccttagccgtagttaggcccccacttcaagaactctgtagcaccgcctacatccctcgctctgctaatcctgttacctggcccctctactgggcctgccaaggctgcgtcctaacgggcctctgggtcatcgcccacgaatgcggccaccacgccttcagcgactac

SEQ ID NO: 776 - DNA, 349 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 777 - DNA, 354 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccctggcccctctactgggcctgccaaggctgcgtcctaacgggcctctgggtcatcgcccacgaatgcggccaccacgccttcagcgactac

SEQ ID NO: 778 - DNA, 342 bp, Artificial
  Mutation in BnaC.FAD2.b introduced by TALE nuclease pair BnFAD2_T01
caggatccatgggtgcaggtggaagaatgcaagtctctcctccctccagctccaccggaaccaacaccctcaaaagcgtcccctgcgagacaccaccattcactctcggagacctcaagaaagcaatcccacctcactgcttcaaacgctccatcccacgctccttctcctcttcgacatcatcatctcctcctccctctaccacctctccacagcctacttccctctcctcccccaccctctcccttaccttggcccctctacggggcctgccaaggctgcgtcctaacgggcctctgggtcatcgcccacgaatgcggccaccacgccttcagcgactac

SEQ ID NO: 779 - DNA, 331 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctggcccctctaccgggcctgccaaggctgcgtcctaacgggcctctgggtcatagcccacgagtgcggccaccacgccttcagcgactac

SEQ ID NO: 780 - DNA, 355 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctccttcctggcccatctactgggcctgccaaggctgcgtcctaacgggcctctgggtcatcgcccacgaatgcggccacaacgccttcagcgactac

SEQ ID NO: 781 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcccctctactgggcctgccaaggctgcgtcctaacgggcctctgggtcatcgcccacgaatgcggccaccacgccttcagcgactac

SEQ ID NO: 782 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttggcctctctactgggcctgccagggctgcgtcctaaccggcgtctgggtcatagcccacgagtgcggccaccacgcctgcagcgactac

SEQ ID NO: 783 - DNA, 334 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctaaagaaagcaatcccacctcactgcttcaaacgctccatcccacgctccttctcctcttcgacatcatcatctcctcctcggctcctccctctaccacctctccacagcctacttccctctcccttacctcgcccctctactgggcctgccaaggctgcgtcctaacgggcctctgggtcatcgcccacgaatgcggccaccacgccttcagcgactac

SEQ ID NO: 784 - DNA, 337 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctcgcccctctactgggcctgccagggctgcgtcctaaccggcgtctgggtcatagcccacgagtgcggccaccacgccttcagcgactac

SEQ ID NO: 785 - DNA, 381 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgctcgccgcagccgaacgaccgagcgcagcgtggcccctctactgggcctgccaaggctgcgtcctaacgggcctctgggtcatcgcccacgaatgcggccaccacgccttcagcgactac

SEQ ID NO: 786 - DNA, 351 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctcttcgacatcatcatctcctcctcggctcctccctctacaacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 787 - DNA, 349 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcggcccctctactgggcctgccaaggctgcgtcctaacgggcctctgggtcatcgcccacgaatgcggccaccacgccttcagcgactac

SEQ ID NO: 788 - DNA, 355 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatcccacgctccttctcctcttcgacatcatcatctcctcctcggctcctccctctaccacctctccacagcctacttccctctcctcccccaccctctcccttaccgcgccctggcccctctactgggcctgccaaggctgcgtcctaacgggcctctgggtcatagcccacgagtgcggccaccacgccttcagcgactac

SEQ ID NO: 789 - DNA, 346 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctgccctctactgggcctgccaaggctgcgtcctaacgggcctctgggtcatcgcccacgaatgcggccaccacgccttcagcgactac

SEQ ID NO: 790 - DNA, 382 bp, Artificial
  Mutation in BnaC.FAD2.b introduced by TALE nuclease pair BnFAD2_T01
caggatccatgggtgcaggtggaagaatgcaagtccctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttcccgctcctcccccaccctctcccttacctcgctcgccgcagccgaacgaccgagcgcagcgtggcccctctactgggcctgccaaggctgcgtcctaacgggcctctgggtcatcgcccacgaatgcggccaccacgccttcagcgactac

SEQ ID NO: 791 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacccctggcccctctactgcgcctgccaaggctgcctcctaacgggcctctgggtcatcgcccacgaatgcggccaccacgccttcagcgactac

SEQ ID NO: 792 - DNA, 468 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctccctgaccttgaggggtcaagccgtgggcctggcacagcaccggcaacagcgccttcaacttttgtatacaaagttgttgcatgcaggcctctgcaggggcaagcacctgggcggctccaggaagccctggcccctctactgggcctgccaaggctgcgtcctaacgggcctctgggtcatcgcccacgaatgcggccaccacgccttcagcgactac

SEQ ID NO: 793 - DNA, 340 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctcccccaccctctcccttacctgcccctctactgggcctgccaaggctgcgtcctaacgggcgtctgggtcatagcccacgagtgcggccaccacgccttcagcgactac

SEQ ID NO: 794 - DNA, 351 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttctggcctctctactgggcctgccagggctgcgtcctaaccggcgtctgggtcatagcccacgagtgcggccaccacgccatcagcgactac

SEQ ID NO: 795 - DNA, 358 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctcgtctggcccatctactgggcctgccaaggctgcgtcctaacgggcctctgggtcatcgcccacgaatgcggccaccacgccttcagcgactac

SEQ ID NO: 796 - DNA, 326 bp, Artificial
  Mutation in BnaC.FAD2.b introduced by TALE nuclease pair BnFAD2_T01
caggatccatgggtgcaggtggaagaatgcaagtctctcctccctccaagtagtctgaaaccgacaccatcaagcgcgtaccctgcgagacaccaccattcactctcggagacctcaagaaagcaatcccacctcactgcttcaaacgctccatccctcgctccttctcctacctcctcttcgacatcctcgtctcctcctccctctaccacctctccacagcctccttccccctccgccccctctactgggcctgccaaggctgcgtcctaacgggcctctgggtcatcgcccacgaatgcggccaccacgccttcagcgactac

SEQ ID NO: 797 - DNA, 337 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctgggcctgccaaggctgcgtcctaacgggcctctgggtcatcgcccacgaatgcggccaccacgccttcagcgactac

SEQ ID NO: 798 - DNA, 352 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgctggcccctctactgggcctgccaaggctgcgtcctaacgggcgtctgggtcatagcccacgagtgcggccaccacgccttcagcgactac

SEQ ID NO: 799 - DNA, 345 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctctctccttctcctacctcctcttcgacatcctcgtctcctcctccctctaccacctctccacagcctacttccctctcctccctcaccctctctcctacttctctctactgggcctgccaagggtgcgtcctaaccggcgtctgggtcatagcccacgagtgcggccaccacgccttcagcgactac

SEQ ID NO: 800 - DNA, 350 bp, Artificial
  Mutation in BnaC.FAD2.b introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttatggcctctctactgggcctgccagggctgcgtcctaaccggcgtctgggtcatagcccacgagtgcggccaccacgccttcagcgactac

SEQ ID NO: 801 - DNA, 345 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcccggcctctctactgggcctgccagggctgcgtcctaaccggcgtctgggtcatagcccacgagtgcggccaccacgccttcagcgactac

SEQ ID NO: 802 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcggcctctctactgggcctgccaagggtgcgtcctaaccggcgtctgggtcatagcccacgagtgcggccaccacgccttcagcgactac

SEQ ID NO: 803 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctctggcccctctactgggcctaccaaggctgcgtcctaacgggcctctgggtcgtcgcccacgaatgcggccaccacgccttcagcgactac

SEQ ID NO: 804 - DNA, 346 bp, Artificial
  Mutation in BnaC.FAD2.b introduced by TALE nuclease pair BnFAD2_T01
caggatccatgggtgcaggtggcagaatgcaagtctctcctccctccagctcccccgaaaccaaaaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctcccacctctccacagcctacttccctctcctccccccccctctccctgacctcccctctactgggcctgccaaggctgcgtcctaacgggcctctgggtcatcgcccacgaatgcggccaccacgccttcagcgactac

SEQ ID NO: 805 - DNA, 324 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctccctctaccacctctccacagcctacttccctctcctccctggcccctctactgggcctgccaaggctgcgtcctaacgggcgtctgggtcatagcccacgagtgcggccaccacgccttcagcgactac

SEQ ID NO: 806 - DNA, 352 bp, Artificial
  Mutation in BnaC.FAD2.b introduced by TALE nuclease pair BnFAD2_T01
caggatccatgggtgcaggtggaagaatgcaagtgtctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttaccccgccggcccctctactgggcctgccaaggctgcgtcctaacgggcctctgggtcatcgcccacgaatgcggccaccacgccttcagcgactac

SEQ ID NO: 807 - DNA, 355 bp, Artificial
  Mutation in BnaC.FAD2.b introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcgcctggcccctctactgggcctgccaaggctgcgtcctaacgggcctctgggtcatcgcccacgaatgcggccaccacgccttcagcgactac

SEQ ID NO: 808 - DNA, 338 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccaccattcactctcggagacctcaagaaagcaatcccacctcactgcttcaaacgctccatccctcgctccttctcctcttcgacatcatcatctcctcctcggctcctccctctaccacctctccacagcctacttccctctcccttacctcgcctgaccctctactgggcctgccaaggctgcgtcctaacgggcctctgggtcatcgcccacgaatgcggccaccacgccttcagcgactac

SEQ ID NO: 809 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctcgatccctcgctctttctcctacctcctcttcgacatcctcgtctcctcctccctctaccacctctccacagcctacttccctctcctccccccccctctcccttacctctggcccctctactgggcctgccaaggctgcgtcctaacgggcctctgggtcatcgcccacgaatgcggccaccacgccttcagcgactac

SEQ ID NO: 810 - DNA, 355 bp, Artificial
  Mutation in BnaC.FAD2.b introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctcccacctctccacagcctacttccctctcctcccccaccctctcccttacctcgcgcctggcccctctactgggcctgccaaggctgcgtcctaacgggcctctgggtcatcgcccacgaatgcggccaccacgccttcagcgactac

SEQ ID NO: 811 - DNA, 343 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctccccctggcccctctactgggcctgccaaggctgcgtcctaacgggcctctgggtcatcgcccacgaatgcggccaccacgccttcagcgactac

SEQ ID NO: 812 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgccctggcccctctactgggcctgccaaggctgcgtcctaacgggcctctgggtcatcgcccacgaatgcggccaccacgccttcagcgactac

SEQ ID NO: 813 - DNA, 352 bp, Artificial
  Mutation in BnaC.FAD2.b introduced by TALE nuclease pair BnFAD2_T01
caggatccatgggtgcaggtggaagaatgcaagtatctcctccctccagctcccccgaaaccaaaaccctcaaacgcgtcccctgcgagacaccacccttcactgtcggagaactcaagaaagcaatcccaccgcactgcttcaaacgctccatccctcgctccttctcctacctcctcttcgacatcctcgtctcctcctccctctaccacctctccacagcctacttccctctcctcccccaccctctcccttacctcgctggcccctctactgggcctgccaaggctgcgtcctaacgggcctctgggtcatcgcccacgaatgcggccaccacgccttcagcgactac

SEQ ID NO: 814 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttctctactgggcctgccaagggtgcgtcctaaccggcgtctgggtcatagcccacgagtgcggccaccacgccttcagcgactac

SEQ ID NO: 815 - DNA, 349 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctctcctactttggcctctctactgggcctgccaaggctgcgtcctaacgggcctctgggtcatcgcccacgagtgcggccaccacgccttcagcgactac

SEQ ID NO: 816 - DNA, 350 bp, Artificial
  Mutation in BnaC.FAD2.b introduced by TALE nuclease pair BnFAD2_T01
caggatccatgggtgcaggtggaagaatgcaagtctctcctccttccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccgctggcccctctactgggcctgccaaggctgcgtcctaacgggcctctgggtcatcgcccacgaatgcggccaccacgccttcagcgactac

SEQ ID NO: 817 - DNA, 343 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacccctctactgggcctgccaaggctgcgtcctaacgggcctctgggtcatcgcccacgaatgcggccaccacgccttcagcgactac

SEQ ID NO: 818 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgtcgtggcccctctactgggcctgccaaggctgcgtcctaacgggcctctgggtcatcgcccacgaatgcggccaacacgccttcagcgactac

SEQ ID NO: 819 - DNA, 261 bp, Artificial
  Mutation in BnaC.FAD2.b introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcgaagacctcaagaaagcaatcccacctcactgcttcaaacgctccatcccacgctccttctcctctccgacatcatcatctcctcctcggctcctccctcaaccgcctctccacaacctacttcccgcgcccctaccacgccttcagcgactac

SEQ ID NO: 820 - DNA, 348 bp, Artificial
  Mutation in BnaC.FAD2.b introduced by TALE nuclease pair BnFAD2_T01
caggatccatgggtgcaggtgacagaatgcaagtctctactccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctgacctggcccctctactgagcctcccatggctgcttcctgacgggcctctgggtcatcgcccgcgaatgcgtccaccacgccttcagcgactac

SEQ ID NO: 821 - DNA, 412 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgctggagacggtccagcggctgttgccggtgctgtgccaggcccacggcttgaccccggagctggcccctctactgggcctgccaaggctgcgtcctaacgggcctctgggtcatcgcccacgaatgcggccaccacgccttcagcgactac

SEQ ID NO: 822 - DNA, 312 bp, Artificial
  Mutation in BnaC.FAD2.b introduced by TALE nuclease pair BnFAD2_T01
caggatccatgggtgcaggtggaagaatgcaagtctatcctccctccagctcccccgaaaccaaaacccgcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctgggtctgccaaggctgcgtcctaacgggcctctgggtcatcgcccacgagtgcggccaccacgccttcagcgactac

SEQ ID NO: 823 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccatctaccacctctccacagcctacttccctctcctcccccaccctctcccttacctccgcctggcccctctactgggcctgccaaggctgcgtcctaacgggcctctgggtcatcgcccacgaatgcggccaccacgccttcagcgactac

SEQ ID NO: 824 - DNA, 312 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctgggtctgccaaggctgcgtcctaacgggcctctgggtcatcgcccacgaatgcggccaccacgccttcagcgactac

SEQ ID NO: 825 - DNA, 414 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgccggcaaaatcgcgccgaaggatgtcgctgccgactgggcaatggagcgcctgccggcccacctggcccctctactgggcctgccaaggctgcgtcctaacgggcctctgggtcatagcccacgagtgcggccaccacgccttcagcgactac

SEQ ID NO: 826 - DNA, 336 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctgggccggccaaggctgcgtcctaacgggcctctgggtcatcgcccacgaatgcggccaccacgccttcagcgactac

SEQ ID NO: 827 - DNA, 381 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccccctcccttcccgcgcgcgccgcagccgaacggccgagcgcaccgtggcccctccactgggcctgccaaggctgcgtcctaacgggcctctgggtcatagcccacgagtgcggccaccacgccttcagcgactac

SEQ ID NO: 828 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctcctcagcctacttccctctcctcccccaccctctcccttacctcccctctactgggcctgccaaggctgcgtcctaacgggcctctgggtcatcgcccacgaatgcggccaccacgccttcagcgactac

SEQ ID NO: 829 - DNA, 339 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctcccccaccctctcccttatggcccctctactgggcctgccaaggctgcgtcctaacgggcctctgggtcatcgcccacgaatgcggccaccacgccttcagcgactac

SEQ ID NO: 830 - DNA, 312 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactctcggagacctcaagaaagcaatcccacctcactgcttcaaacgctccatccctcgctccttctcctacctcctcttcgacatcctcgtctcctcctccctctaccacctctccacagcctacttccctctgggtctgccaaggctgcgtcctaacgggcctctgggtcatcgcccacgaatgcggccaccacgccttcagcgactac

SEQ ID NO: 831 - DNA, 347 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgcttcaaacgctccatccctcgctccttctcctacctcctcttcgacatcctcgtctcctcctccctctaccacctctccacagcctacttccctctcctcccccaccctctccctgcccggcccctctactgggcctgccaaggctgcgtcctaacgggcctctgggtcatcgcccacgagtgcggccaccacgccttcagcgactac

SEQ ID NO: 832 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttggcccctctactgggcctgccaaggctgcgtcctaacgggcctctgggtcatcgcccacgaatgcggccaccacgccttcagcgactac

SEQ ID NO: 833 - DNA, 350 bp, Artificial
  Mutation in BnaC.FAD2.b introduced by TALE nuclease pair BnFAD2_T01
caggatccatgggtgcaggtgcaagaatgcaagtctctcctcactccagctcccccgaaaccaaaaccctcaaacgcgtcccctgcgagacaccaccattcactctcggagacctcaagaaagcaatcccacctcactgcttcaaacgcaccatccctcgctccttctcctacctcctcttcgacatcctcgtctcctcctccctctaccacctctccacagcctacttccctctcctcccccaccctctcccttaccgctggcccctctactgggcctgccaaggctgcgtcctaacgggcctctgggtcatcgcccacgaatgcggccaccacgccttcagcgactac

SEQ ID NO: 834 - DNA, 340 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatagcctcctgcttctactacgtcgccaccacttacttccctctcctccctcaccctctctcctactggcctctctactgggcctgccagggctgcgtcctaaccggcgtctgggtcatagcccacgagtgcggccaccacgccttcagcgactac

SEQ ID NO: 835 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccctggcccctctactgggcctgccaaggctgcgtcataacgggcctctgggtcatcgcccacgaatgcggccaccacgccttcagcgactac

SEQ ID NO: 836 - DNA, 351 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagaccccaagaaagcaatcccccctcactgcttcaaacgctccatcccacgctccttctcctcttcgccatcctcgtctcctcctccctctaccacctctccacagcctacttccctctcctccctccccctctctcctacttcgcctaacctggcctctctactgggcctgccaagggtgcgtcctaacgggcctctgggtcatcgcccacgaatgcggccaccacgccttcagcgactac

SEQ ID NO: 837 - DNA, 261 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttccctctcccttaccacgccttcagcgactac

SEQ ID NO: 838 - DNA, 311 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctcaccctctctcctacttgcctctctactgggcctgccagggctgcgtcctaaccggcgtctgggtcatagcccacgagtgcggccaccacgccttcagcgactac

SEQ ID NO: 839 - DNA, 350 bp, Artificial
  Mutation in BnaC.FAD2.b introduced by TALE nuclease pair BnFAD2_T01
caggatccatgggtgcaggtggaagaatgcaagtctctcctcactccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccccctggcccctctactgggcctgccaaggctgcgtcctaacgggcctctgggtcatcgcccacgaatgcggccaccacgccttcagcgactac

SEQ ID NO: 840 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttggcccctctactgggcctgccaaggctgcgtcctaacgggcctctgggtcatagcccacgagtgcggccaccacgccttcagcgactac

SEQ ID NO: 841 - DNA, 355 bp, Artificial
  Mutation in BnaC.FAD2.b introduced by TALE nuclease pair BnFAD2_T01
caggatccatgggtgcaggtggaagaatgcaagtgtctactccctccaaaaagtatgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctccccccccccctccctcaccccgcgcctggcccctctactgggcctgccaaggctgcgtcctaacgggcctctgggtcatagcccacgagtgcggccaccacgccttcagcgactac

SEQ ID NO: 842 - DNA, 349 bp, Artificial
  Mutation in BnaC.FAD2.b introduced by TALE nuclease pair BnFAD2_T01
caggatccatgggtgcaggtggaataatgcaagtctctcctccctccagctccccaggaaccaacaccctcaaacccgtcccctgcgagccaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttgccttcggccctcgactgggccagccaaggctgcgtcctaacgggcctctgggtcatcgccctcgaattcggcgaccacgccttcagcgactac

SEQ ID NO: 843 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgccccatccctcgctccttctcctacctcctcttcgacatcctcgtctcctcctccctctaccacctctccacagcctacttccctctcctcccccaccctctcccttacctcccctctactgggcctgccaaggctgcgtcctaacgggcctctgggtcatcgcccacgaatgcggccaccacgccttcagcgactac

SEQ ID NO: 844 - DNA, 347 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttatggcccctctactgggcctgccaaggctgcgtcctaacgggcctctgggtcatcgcccacgaatgcggccaccacgccttcagcgactac

SEQ ID NO: 845 - DNA, 337 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccctctactgggcctgccaaggctgcgtcctaacgggcctctgggtcatcgcccacgaatgcggccaccacgccttcagcgactac

SEQ ID NO: 846 - DNA, 357 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgccgcctggcccctctactgggcctgccaaggctgcgtcctaacgggcctctgggtcatcgcccacgaatgcggccaccacgccttcagcgactac

SEQ ID NO: 847 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctccctctaccacctctccacagcctacttccctctcctcccccaccctctcccttacctctggcccctctacggggcctgccaaggctgcgtcctaacgggcctctgggtcatagcccacgagtgcggccaccacgccttcagcgactac

SEQ ID NO: 848 - DNA, 340 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctccctctactgggcctgccaaggctgcgtcctaacgggcctctgggtcatcgcccacgaatgcggccaccacgccttcagcgactac

SEQ ID NO: 849 - DNA, 313 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctcaccctctctcctacttcggcctctctactgggcctgccaagggtgcgtcctaaccggcgtctgggtcatagcccacgagtgcggccaccacgccttcagcgactac

SEQ ID NO: 850 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccaaagcctacttccctctcctccctcaccctctctcctggcctctctactgggcctgccaagggtgcgtcctaaccggcgtctgggtcatagcccacgagtgcggccaccacgccttcagcgactac

SEQ ID NO: 851 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacccctctactgggcctgccaaggctgcgtcctaacgggcctctgggtcatcgcccacgaatgcggccaccacgccttcagcgactac

SEQ ID NO: 852 - DNA, 348 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 853 - DNA, 401 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctagcctcgggcatccaagcagcaagcgcgttacgccgtgggtcgatgtttgactggcccctctactgggcctgccaaggctgcgtcctaacgggcctctgggtcatagcccacgagtgcggccaccacgccttcagcgactac

SEQ ID NO: 854 - DNA, 356 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccgcctggcccctctactgggcctgccaaggctgcgtcctaacgggcctctgggtcatcgcccacgaatgcggccaccacgccttcagcgactac

SEQ ID NO: 855 - DNA, 331 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtccccagcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccctggcccctctactgggcctgccaaggctgcgtcctaacgggcctctgggtcatcgcccacgaatgcggccaccacgccttcagcgactac

SEQ ID NO: 856 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgcttcaaacgctccatccctcgctccttctcctacctcctcttcgacatcctcgtctcctcctccctctaccacctctccacagcctacttccctctcctcccccaccctctcgcctggcccctctactgggcctgccaaggctgcgtcctaacgggcctctgggtcatcgcccacgaatgcggccaccacgccttcagcgactcc

SEQ ID NO: 857 - DNA, 356 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctccctaccctcgcgcctggcccctctactgggcctgccaaggctgcgtcctaacgggcctctgggtcatcgcccacgaatgcggccacgacgccttcagcgactac

SEQ ID NO: 858 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctcccccttacctctactgggcctgccaaggctgcgtcctaacgggcctctgggtcatcgcccacgaatgcggccaccacgccttcagcgactac

SEQ ID NO: 859 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctctggcccctctactgggcctgccaaggctgcgtcctaacgggcctctgggtcatcgcccacgaatgcggccaccacgccttcagcgactac

SEQ ID NO: 860 - DNA, 350 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttccctctggcccctctactgggcctgccaaggctgcgtcctaacgggcctctgggtcatcgcccacgaatgcggccaccacgccttcagcgactac

SEQ ID NO: 861 - DNA, 339 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctattactgggcctgccagggctgcgtcctaaccggcgtctgggtcatagcccacgagtgcggccaccacgcctgcagcgactac

SEQ ID NO: 862 - DNA, 345 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttctctctactgggcctgccaagggtgcgtcctaaccggcgtctgggtcatagcccacgagtgcggccaccacgccttcagcgactac

SEQ ID NO: 863 - DNA, 348 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcccctctactgggcctgccaaggctgcgtcctaacgggcctctgggtcatcgcccatgaatgcggccaccacgccttcagcgactac

SEQ ID NO: 864 - DNA, 338 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctccctctctactgggcctgccaagggtgcgtcctaaccggcgtctgggtcatagcccacgagtgcggccaccacgccttcagcgactac

SEQ ID NO: 865 - DNA, 350 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcctcccccaccctcccccttccctctggcccctctactgggcctgccaaggctgcgtcctaacgggcctctgggtcatagcccacgagtgcggccaccacgccttcagcgactac

SEQ ID NO: 866 - DNA, 340 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctccccccctctactgggcctgccaaggctgcgtcctaacgggcctctgggtcatcgcccacgaatgcggccaccacgccttcagcgactac

SEQ ID NO: 867 - DNA, 336 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctcccccaccctctccctggcccctctactgggcctgccaaggctgcgtcctaacgggcctctgggtcatagcccacgagtgcggccaccacgccttcagcgactac

SEQ ID NO: 868 - DNA, 356 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgccacctggcccctctactgggcctgccaaggctgcgtcctaacgggcctctgggtcatcgcccacgaatgcggccaccacgccttcagcgactac

SEQ ID NO: 869 - DNA, 423 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctactgtgccaggcccacggcttgaccccggagcaggtggtggccatcgccagccacgatggcggcaacagccgctggactggcctctctactgggcctgccagggctgcgtcctaaccggcgtctgggtcatagcccacgagtgcggccaccacgccttcagcgactac

SEQ ID NO: 870 - DNA, 336 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagaccacaagaaagcaatcccacctcactgcttcaaacgctccatccctcgctccttctcctacctcctcttcgacatcctcgtctcctcctccctctaccacctctccacagcctacttccctctcctcccccaccctctcccttacctgggcctgccaaggctgcgtcctaacgggcctctgggtcatcgcccacgaatgcggccaccacgccttcagcgactac

SEQ ID NO: 871 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagccacgatggcggcaagcaggcgctggagcctggcccctctactgggcctgccaaggctgcgtcctaacgggcctctgggtcatcgcccacgaatgtggccaccacgccttcagcgactac

SEQ ID NO: 872 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaagggtgcgtcctaaccggcgtctgggtcatagcccacgagtgcggccaccacgccttcagcgactac

SEQ ID NO: 873 - DNA, 331 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctccacttcgacatcctcgtctcctcctccctctaccacctctccacagcctacttccctctcctccctggcccctctactgggcctgccaaggctgcgtcctaacgggcctctgggtcatcgcccacgaatgcggccaccacgccttcagcgactac

SEQ ID NO: 874 - DNA, 334 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctccctctaccacctctccacagccgacttccctctcctcccccaccctctcccttacctctactgggcctgccaaggctgcgtcctaacgggcctctgggtcatagcccacgagtgcggccaccacgccttcagcgactac

SEQ ID NO: 875 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctctccctggcccctctactgggcctgccaagggtgcgtcctaaccggcgtctgggtcatagcccacgagtgcggccaccacgccttcagcgactac

SEQ ID NO: 876 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctccgcctggcctctctactgggcctgccaagggtgcgtcctaaccggcgtctgggtcatagcccacgagtgcggccaccacgccttcagcgactac

SEQ ID NO: 877 - DNA, 414 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctcggctcctccctctaccacctctcctcccccaccctctcccttaccttgcggatttgaacgttgtgaagcaacggcccggggggtggcgggccaccacctgctggggggtcaagccgtgggcctgacccctctactgggcctgccaaggctgcgtcctaacgggcctctgggtcatagcccacgagtgcggccaccacgccttcagcgactac

SEQ ID NO: 878 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgcctcctcctccctctaccacctctccacagcctacttccctctcctccctcaccctctctcctacttctggcctctctactgggcctgccaagggtgcgtcctaaccggcgtctgggtcatagcccacgagtgcggccaccacgccttcagcgactac

SEQ ID NO: 879 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgccctggcctctctactgggcctgccaagggtgcgtcctaaccggcgtctgggtcatagcccacgagtgcggccaccacgccttcagcgactac

SEQ ID NO: 880 - DNA, 310 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctcaccctctctcctacggcctctctactgggcctgccaagggtgcgtcctaaccggcgtctgggtcatagcccacgagtgcggccaccacgccttcagcgactac

SEQ ID NO: 881 - DNA, 337 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcccttacccgcctgacccctctactgggcctgccaaggctgcgtcctaacgggcctctgggtcatagcccacgagtgcggccaccacgccttcggcgactac

SEQ ID NO: 882 - DNA, 355 bp, Artificial
  Mutation in BnaC.FAD2.b introduced by TALE nuclease pair BnFAD2_T01
caggatccatgggtgcaggtggaagaatgcaagtctctcctccctccagctcccccggaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctaccacctctccacagcctacttccctctcctcccccaccctctcccttaccgcgccgcctggcccctctacggggcctgccaaggctgcgtcctaacgggcctctgggtcatcgcccacgaatgcggccaccacgccttcacgactac

SEQ ID NO: 883 - DNA, 338 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttacctcgcctgaccctctactgggcctgccaaggctgcgtcctaacgggcctctgggtcatcgcccacgaatgcggccaccacgccttcagcgactac

SEQ ID NO: 884 - DNA, 261 bp, Artificial
  Mutation in BnaC.FAD2.b introduced by TALE nuclease pair BnFAD2_T01
caggatccatgggtgcatgtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttaccacgccttcagcgactac

SEQ ID NO: 885 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccccctccctctcccttacctcggcccctctactgggcctgccaaggctgcgtcctaacgggcctctgggtcatcgcccacgaatgcggccaccacgccttcagcgactac

SEQ ID NO: 886 - DNA, 333 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcagcctctctactgggcctgccaagggtgcgtcctaaccggcgtctgggtcatagcccacgagtgcggccaccacgccttcagcgactac

SEQ ID NO: 887 - DNA, 350 bp, Artificial
  Mutation in BnaC.FAD2.b introduced by TALE nuclease pair BnFAD2_T01
caggatccattggtgcaggtggaagaatgcaagtgtctcctccctccaagaagtctgaaaccgacaccatcaagcgcgtaccctgcgagacaccacccttcactgtcggagaactcaagaaagcaatcccaccgcactgtttcaaacgctccatccctcgctccttctcctccctcctcttcgacatcctcgtctcctcctccctctaccacctctccacagcctacttccctctccgcccccaccctctcccttacccctggcccctctactgggcctgccaaggctgcgtcctaacgggcctctgggtcatcgcccacgaatgcggccaccacgccttcagcgactac

SEQ ID NO: 888 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttagacatcctcgtctcctcctccctctaccacctctccacagcctacttccctctcctccctcaccctctctcctacttgcctctctactgggcctgccagggctgcgtcctaaccggcgtctgggtcatagcccacgagtgcggccaccacgccttcagcgactac

SEQ ID NO: 889 - DNA, 333 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgccattcactctcggagacctcaagaaagcaatcccacctcactgcttcaaacgctccatcccacgctccttctcctcttcgacatcctcgtctcctcctccctctaccacctctccacagcctacttccctctcctccccccccctctccctccctctactgggcctgccaaggctgcgtcctaacgggcctctgggtcatcgcccacgaatgcggccaccacgccttcagcgactac

SEQ ID NO: 890 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttatactgggcctgccagggctgcgtcctaaccggcgtctgggtcatagcccacgagtgcggccaccacgccttcagcgactac

SEQ ID NO: 891 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctctgagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcctctctactgggcctgccaagggtgcgtcctaaccggcgtctgggtcatagcccacgagggcggccaccacgccttcagcgactac

SEQ ID NO: 892 - DNA, 344 bp, Artificial
  Mutation in BnaC.FAD2.b introduced by TALE nuclease pair BnFAD2_T01
caggatccatgggtgcaggtggaagaatgcaagtctctcctccctccagatcccccgaaaccgacaccctcaaacgcgtcccctgcgagacaccacccttcactctcggagacctcaagaaagcaatcccacctcactgcttcaaacgctccatccctcgctccttctcctacctcctcttcgacatcctcttctcctcctgcctctaccacctctccacagcctacttccctctcctcccccaccctctcccttggcccctctactgggcctgccaaggctgcgtcctaacgggcctctgggtcatcgcccacgaatgcggccaccacgccttcagcgactac

SEQ ID NO: 893 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggccctctactgggcctgccaaggctgcgtcctaacgggcctctgggtcatcgcccacgaatgcggccaccacgccttcagcgactac

SEQ ID NO: 894 - DNA, 313 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctcaccctctctcctactttggcctctctactgggcctgccagggctgcgtcctaaccggcgtctgggtcatagcccacgagtgcggccaccacgccttcagcgactac

SEQ ID NO: 895 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacccctctactgggcctgccaaggctgcgtcctaacgggcctctgggtcatcgcccacgaatgcggccaccacgccttcagcgactac

SEQ ID NO: 896 - DNA, 312 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctgggtctgccaaggctgcgtcctaacgggcctctgcgtcatagcccacgagtgcggccacgacgccttcagcgactac

SEQ ID NO: 897 - DNA, 331 bp, Artificial
  Mutation in BnaC.FAD2.b introduced by TALE nuclease pair BnFAD2_T01
caggatccatgggtgcaggtggcagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctccctggcccctctactgggcctgccaaggctgcgtcctaacgggcctctgggtcatcgcccacgaatgcggccaccacgccttcagcgactac

SEQ ID NO: 898 - DNA, 335 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgctagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcccttacctctggcccctctactgggcctgccaaggctgcgtcctaacgggcctctgggtcatcgcccacgaatgcggccaccacgccttcagcgactac

SEQ ID NO: 899 - DNA, 347 bp, Artificial
  Mutation in BnaC.FAD2.b introduced by TALE nuclease pair BnFAD2_T01
caggatccatgggtgcaggtggaagaatgcaagtctctcctccctacagctccaccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttccctgccctctactgggcctgccaaggctgcgtcctaacgggcctctgggtcatcgcccacgaatgcggccaccacgccttcagcgactac

SEQ ID NO: 900 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccatccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctctactgggcctgccaaggctgcgtcctaacgggcctctgggtcatcgcccacgaatgcggccaccacgccttcagcgactac

SEQ ID NO: 901 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccctggcccctctactgggcctgccaaggctgcgtcctaacgggcctctgggtcatcgcccacgaatgcggccaccacgccttcagcgactac

SEQ ID NO: 902 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcgtatacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttggcctctctactgggcctgccagggctgcgtcctaaccggcgtctgggtcatagcccacgagtgcggccaccacgccttcagcgactac

SEQ ID NO: 903 - DNA, 381 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgctcgccgcagccgaacgaccgagcgcagcgtggcccctctactgggcctgccaaggctgcgtcctaacgggcctctgggtcatcgcccacgaatgcggccaccacgccttcagcgactac

SEQ ID NO: 904 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttcccttggcccctctactgggcctgccaaggctgcgtcctaacgggcctctgggtcatcgcccacgaatgcggccaccacgccttcagcgactac

SEQ ID NO: 905 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagccacgatggcggcaagcaggcgctggagcctggcccctctactgggcctgccaaggctgcgtcctaacgggcctctgggtcatcgcccacgaatgcggccaccacgccttcagctactac

SEQ ID NO: 906 - DNA, 261 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaccatcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttaccacgccttcagcgactac

SEQ ID NO: 907 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctccttggcctctctactgggcctgccagggctgcgtcctaaccggcgtctgggtcatagcccacgagtgcggccaccacgccttcagcgactac

SEQ ID NO: 908 - DNA, 349 bp, Artificial
  Mutation in BnaC.FAD2.b introduced by TALE nuclease pair BnFAD2_T01
caggatccatgggtgcaggtggaagaatgcaagtgtatcctccctccaagaagtctgaaaccgacaccatcaagcgcgtaccctgcgagacaccgcccttcactgtcagagaactcaagaaagcaatcccaccgcactgtttcaaacgctcgatccctcgctctttctcctacctcctcttcgacatcctcgtctcctcctccctctaccacctctccacagcctacttctctctcctcccccaccctctcccttaccttggcccctctactgggcctgccaaggctgcgtcctaacgggcctctgggtcatcgcccacgaatgcggccaccacgccttcagcgactac

SEQ ID NO: 909 - DNA, 336 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctgggcctgccaaggctgcgtcctaacgggcctctgggtcatcgcccacgaatgcggccaccacgccttcagcgactac

SEQ ID NO: 910 - DNA, 358 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctcggctcctccctctaccacctctccacagcctacttccctctcctcccccaccctttcccttccctctggcccctctccggggcctgccaaggctgcgtcctaacgggcctctgggtcatcgcccacgagtgcggccaccacgccttcagcgactac

SEQ ID NO: 911 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctccccccccctctccactggcccctctactgggcctgccaaggctgcgtcctaacgggcctctgggtcatcgcccacgaatgcggccaccacgccttcagcgactac

SEQ ID NO: 912 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctggcccctctactgggcctgccaaggctgcgtcctaacgggcctctgggtcatcgcccacgaatgcggccaccacgccttcagcgactac

SEQ ID NO: 913 - DNA, 345 bp, Artificial
  Mutation in BnaC.FAD2.b introduced by TALE nuclease pair BnFAD2_T01
caggatccatgggtgcaggtggcagaatgcaagtctatactccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctcgcctggcctccctactgggcctgccaaggcggcgtcctaacgggcctctgggtcatagcccacgagtgcggccaccacgcctgcagcgactac

SEQ ID NO: 914 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctattggcctctctactgggcctgccaagggtgcgtcctaaccggcgtctgggtcatagcccacgagtgcggccaccacgccttcagcgactac

SEQ ID NO: 915 - DNA, 345 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttccctccctctactgggcctgccaaggctgcgtcctaacgggcctctgggtcatagcccacgagtgcggccaccacgccttcagcgactac

SEQ ID NO: 916 - DNA, 331 bp, Artificial
  Mutation in BnaC.FAD2.b introduced by TALE nuclease pair BnFAD2_T01
caggatccatgggtgcaggtggcagaatgcaagtctctcctccatccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctggcccctctactgggcctgccaaggctgcgtcctaacgggcctctgggtcatcgcccacgaatgcggccaccacgccttcagcgactac

SEQ ID NO: 917 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaacaaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 918 - DNA, 261 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcacttcttcaaacgctccatcccacgctccttctcctcttcgacatcatcatctcctcctcggctcctccctctaccacctctccacagcctacttccctctcccttaccacgccttcagcgactac

SEQ ID NO: 919 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttccctctggcccctctactgggcctgccaaggctgcgtcctaacgggcctctgggtcatagcccacgagtgcggccaccacgccttcagcgactac

SEQ ID NO: 920 - DNA, 343 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccaccattcactctcggagacctcaagaaagcaatcccacctctctgcttcaaacgctccatccctcgctccttctcctacctcctcttcgacatcctcgtctcctcctccctctaccacctctccacagcctacttccctctcctcccccaccctctccctggcccctctactgggcctgccaaggctgcgtcctaacgggcctctgggtcatcgcccacgaatgcggccaccacgccttcagcgactac

SEQ ID NO: 921 - DNA, 337 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccctctactgggcctgccaaggctgcgtcctaacgggcctctgggtcatcgcccacgaatgcggccaccacgccttcagcgactac

SEQ ID NO: 922 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatagcctcctgcttctactacgtcgccaccacttacttccctctcctccctcaccctctctcctacttcgcccctggcctctctactgggcctgccaagggtgcgtcctaaccggcgtctgggtcatagcccacgagtgcggccaccacgccttcagcgactac

SEQ ID NO: 923 - DNA, 425 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctggcggatttgaacgttgtgaagcaacggcccggagggtggcgggccaccacctgctggggggtcaagccgtgggcctggcccctctactgggcctgccaaggctgcgtcctaacgggcctctgggtcatcgcccacgaatgcggccaccacgccttcagcgactac

SEQ ID NO: 924 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttggcctctctactgggcctgccagggctgcgtcctaaccggcgtctgggtcatagcccacgagtgcggccaccacgccttcagcgactac

SEQ ID NO: 925 - DNA, 311 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaaacgcgtcccctgcgagacaccacccttcactctcggagacctcaagaaagcaatcccacctcactgcttcaaacgctccatcccacgctccttctcctcttcgacatcatcatctcatcccccaccctctcccttacctcgcctcgtctggcccctctactgggcctgccaaggctgcgtcctaacgggcctctgggtcatcgcccacgaatgcggccaccacgccttcagcgactac

SEQ ID NO: 926 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcggcccctctactgggcctgccaaggctgcgtcctaacgggcctctgggtcatcgcccacgaatgcggccaccacgccttcagcgactac

SEQ ID NO: 927 - DNA, 306 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctcaccctctctcctactctctactgggcctgccaagggtgcgtcctaaccggcgtctgggtcatagcccacgagtgcggccaccacgccttcagcgactac

SEQ ID NO: 928 - DNA, 422 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgttgccggtgctgtgccaggcccacggcttgaccccggagcaggtggtggccatcgccagcaatattggtgctggcccctctactgggcctgccaaggctgcgtcctaacgggcctctgggtcatcgcccacgaatgcggccaccacgccttcagcgactac

SEQ ID NO: 929 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcccttacctcgccacctggcccctctactgggcctgccaaggctgcgtcctaacgggcctctgggtcatagcccacgagtgcggccaccacgccttcagcgactac

SEQ ID NO: 930 - DNA, 341 bp, Artificial
  Mutation in BnaC.FAD2.b introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccccccccctctccctccctctactgggcctgccaaggctgcgtcctaacgggcctctgggtcatagcccacgagtgcggccaccacgccttcagcgactac

SEQ ID NO: 931 - DNA, 307 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctcaccctctctcctacctctctactgggcctgccaagggtgcgccctaaccggcgtctgggtcatagcccacgagtgcggccaccacgccttcagcgactac

SEQ ID NO: 932 - DNA, 336 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctgggcctgccaaggctgcgtcctaacgggcctctgggtcatcgcccacgaatgcggccaccacgccttcagcgactac

SEQ ID NO: 933 - DNA, 345 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctccctctactgggcctgccaaggctgtgtcctaacgggcctctgggtcatcgcccacgaatgcggccaccacgccttcagcgactac

SEQ ID NO: 934 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttcccttggcccctctactgggcctgccaaggctgcgtcctaacgggcctctgggtcatagcccacgagtgcggccaccacgccttcagcgactac

SEQ ID NO: 935 - DNA, 355 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcgcctggcccctctactgggcctgccaaggctgcgtcctaacgggcctctgggtcatagcccacgagtgcggccaccacgccttcagcgactac

SEQ ID NO: 936 - DNA, 355 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccctccctctcccttccctccttcctggcccctctactgggcctgccaaggctgcgtcctaacgggcctctgggtcatagcccacgagtgcggccaccacgccttcagcgactac

SEQ ID NO: 937 - DNA, 331 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctggcccctctactgggcctgccaaggctgcgtcctaacgggcctctgggtcatagcccacgagtgcggccaccacgccttcagcgactac

SEQ ID NO: 938 - DNA, 342 bp, Artificial
  Mutation in BnaC.FAD2.b introduced by TALE nuclease pair BnFAD2_T01
caggatccatgggtgcaggtggaagaatgcaagtctctcctccctccagctccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctaccacctctccacagcctacttccctctcctcccccaccctcgcccttacccctctactgggcctgccaaggctgcgtcctaacgggcctctgggtcatcgcccacgaatgcggccaccacgccttcagcgactac

SEQ ID NO: 939 - DNA, 348 bp, Artificial
  Mutation in BnaC.FAD2.b introduced by TALE nuclease pair BnFAD2_T01
caggatccatgggtgcaggtgcaagaatgcaagtctctcctccctccagctcccccgaaaccaaaaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccgggcccctctactgggcctgccaaggctgcgtcctaacgggcctctgggtcatagcccacgagtgcggccaccacgccttcagcgactac

SEQ ID NO: 940 - DNA, 346 bp, Artificial
  Mutation in BnaC.FAD2.b introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttatggcccctctactgggcctgccaaggctgcgtcctaacgggcctctgggtcatcgcccacgaatgcggccaccacgccttcagcgactac

SEQ ID NO: 941 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaagggtgcgtcctaaccggcgtctgggtcatagcccacgagtgcggccaccacgccttcagcgactac

SEQ ID NO: 942 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcggccaccacgccatcagcgactac

SEQ ID NO: 943 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaacaccctcaaacgcgtcccctgcgagacaccaccattcactctcggagacctcaagaaagcaatcccacctcactgcttcaaacgctccatccctcgctccttctcctacctcctcttcgacatcctcctctcctcctccctctaccccctctccaccgcctccttccctctcccccccccccctctcccttcccttggcccctctactgggcctgccaaggctgcgtcctaacgggcctctgggtcatcgcccacgaatgcggccaccacgccttcagcgactac

SEQ ID NO: 944 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccggcccctctactgggcctgccaaggctgcgtcctaacgggcctctgggtcatcgcccacgaatgcggccaccacgccttcagcgactac

SEQ ID NO: 945 - DNA, 358 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctcgtctggcccctctactgggcctgccaaggctgcgtcctaacgggcctctgggtcatagcccacgagtgcggccaccacgccttcagcgactac

SEQ ID NO: 946 - DNA, 339 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctctctactgggcctgccaagggtgcgtcctaaccggcgtctgggtcatagcccacgagtgcggccaccacgccttcagcgactac

SEQ ID NO: 947 - DNA, 333 bp, Artificial
  Mutation in BnaC.FAD2.b introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctgggcctgccaagggtgcgtcctaaccggcgtctgggtcatagcccacgagtgcggccaccacgccttaagcgactac

SEQ ID NO: 948 - DNA, 345 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagacctcaagaaagcaatcccacctcactgcttcaaacgctccatcccacgctccttctcctcttcgacatcatcatctcctcctcggctcctccctctaccacctctccacagcctacttccctctcctcccccaccctctcgcctggcccctctactgggcctgccaaggctgcgtcctaacgggcctctgggtcatagcccacgagtgcggccaccacgccttcagcgactac

SEQ ID NO: 949 - DNA, 358 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctcccctccccccccctctcccttacctcgcctcgtctggcccctctacggggcctgccaaggctgcgtcctaacgggcctctgggtcatcgcccacgaatgcggccaccacgccttcagcgactac

SEQ ID NO: 950 - DNA, 401 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttgcctcgggcgtccaagcagcaagcgcgttacgccgtgggtcgatgtttgactggcccctctactgggcctgccaaggctgcgtcctaacgggcctctgggtcatcgcccacgaatgcggccaccacgccttcagcgactac

SEQ ID NO: 951 - DNA, 341 bp, Artificial
  Mutation in BnaC.FAD2.b introduced by TALE nuclease pair BnFAD2_T01
caggatccatgggtgcaggtgcaagaatgcaagtctctcctccctccagctctcccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacaccctacttccctctcctcccccaccctctccctcgcctctactgggcctgccaaggctgcgtcctaacgggcctctgggtcatcgcccacgaatgcggccaccacgccttcagcaactac

SEQ ID NO: 952 - DNA, 394 bp, Artificial
  Mutation in BnaC.FAD2.b introduced by TALE nuclease pair BnFAD2_T01
caggatccatgggtgcaggtgaaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatccctcgctccttctcctacctcctcttcgacatcctcgtctcctcctccctctaccacctctccacagcctacttccctctcctcccccaccctctccctggcctcgggggcggatttgaacgttgtgaagcaacggcccggaggggggcgggcgtctctactgggcctgccaaggctgcgtcctaacgggcctctgggtcatagcccacgagtgcggccaccacgccttcagcgactac

SEQ ID NO: 953 - DNA, 351 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgctggcccctctacggggcctgccaaggctgcgtcctaacgggcctctgggtcatcgcccacgaatgcggccaccacgccttcagcactac

SEQ ID NO: 954 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcacccggaaccaacaccctcaaacgcgtcccctgcgagacaccaccattcactctcggagaactcaagaaagcaatcccacctcactgcttcaaacgctccatcccacgctccttctcctcttcgacatcatcatctcctcctcggctcctccctctaccacctctccacagccttcttccctctcctcccccaccccctcccttacccgtactgggccttccaaagcggcgtacgtacatgcctctgggtcatagcccacgatggcgtccaccacgccatcagcgactac

SEQ ID NO: 955 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttatggcccctctactgggcctgccaaggctgcgtcctaacgggcctctgggtcatagcccacgagtgcggccaccacgccttcagcgactac

SEQ ID NO: 956 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctactggcctctctactgggcctgccaagggtgcgtcctaaccggcgtctgggtcatagcccacgagtgcggccaccacgccttcagcgactac

SEQ ID NO: 957 - DNA, 343 bp, Artificial
  Mutation in BnaC.FAD2.b introduced by TALE nuclease pair BnFAD2_T01
taggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccacccctcgctccttctcctacctcctcttcgacatcctcgtctcctcctccctctaccacctctccacagcctacttccctctcctcccccaccctctccctggcccctctactgggcctgccaaggctgcgtcctaacgggcctctgggtcatagcccacgagtgcggccaccacgccttcagcgactac

SEQ ID NO: 958 - DNA, 346 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttatggcccctctactgggcctgccaaggctgcgtcctaacgggcctctgggtcatcgcccacgaatgcggccaccacgccttcagcgactac

SEQ ID NO: 959 - DNA, 379 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctaacggagcctttcgttttatctgttgtttgtcggtggcctctctactgggcctgccaaggctgcgtcctaacgggcctctgggtcatagcccacgagtgcggccaccacgccttcagcgactac

SEQ ID NO: 960 - DNA, 326 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccatcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccccctctactgggcctgccaaggctgcgtcctaacgggcctctgggtcatcgcccacgaatgcggccaccacgccttcagcgactac

SEQ ID NO: 961 - DNA, 326 bp, Artificial
  Mutation in BnaC.FAD2.b introduced by TALE nuclease pair BnFAD2_T01
caggatccatgggtgcaggtggaagaattcaagtctctcctccctccagctcccccggaaccaacaccctcaaacccgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccccctctactgggcctgccaaggctgcgtcctaacgggcctctgggtcatcgcccacgaatgcggccaccacgccttcagcgactac

SEQ ID NO: 962 - DNA, 419 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccccccccctcccccttagccgtagttaggcccccacttcaagaactctgtagcaccgcctacatacctcgctctgctaatcctgttacctggcccctctactgggcctgccaaggctgcgtcctaacgggcctctgggtcatcgcccacgaatgcggccaccacgccttcagcgactac

SEQ ID NO: 963 - DNA, 345 bp, Artificial
  Mutation in BnaC.FAD2.b introduced by TALE nuclease pair BnFAD2_T01
caggatccatgggtgcaggtcgaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctcgcctggcctctctactgggcctgccagggctgcgtcctaaccggcgtctgggtcatagcccacgagtgcggccaccacgcctttagcgactac

SEQ ID NO: 964 - DNA, 337 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccctctactgggcctgccaaggctgcgtcctaacgggcctctgggtcatcgcccacgaatgcggccaccacgccttcagcgactac

SEQ ID NO: 965 - DNA, 331 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcatcatctcctcctcggctcctccctctaccacctctccacagcctacttcgcctggcctctctactgggcctgccagggctgcgtcctaaccggcgtctgggtcatagcccacgagtgcggccaccacgccttcagcgactac

SEQ ID NO: 966 - DNA, 341 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccacctcactgcttcaaacgctccatcccacgctccttctcctcttcgacatcatcatctcctcctcggctcctccctctaccacctctccacagcctacttccctctcctcccccacccgcctggcccctctactgggcctgccaaggctgcgtcctaacgggcctctgggtcatcgcccacgaatgcggccaccacgccttcagcgactac

SEQ ID NO: 967 - DNA, 349 bp, Artificial
  Mutation in BnaC.FAD2.b introduced by TALE nuclease pair BnFAD2_T01
caggatccattggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcggcctctctactgggcctgccaagggtgcgtcctaaccggcctctgggtcatagcccacgagtgcggccaccacgccttcagcgactac

SEQ ID NO: 968 - DNA, 480 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccccctccccccctcccccccccccacagcctccttcccccccccccccccccctcccccttccctctccagcggctgttgccggtgctgtgccaggcccccggcttgaccccggagcaggtggtggccatcgccagccacgatggtggcccctctactgggcctgccaaggctgcgtcctaacgggcctctgggtcatcgcccacgaatgcggccaccacgccttcagcgactac

SEQ ID NO: 969 - DNA, 332 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactctcggagacctcaagaaagcaatcccacctcactgcttcaaacgctccatcccacgctccttctcctcttcgacatcatcatctcctcctcggctcctccctctaccacctctccacagcctacttccctctcccttacctcccctctactgggcctgccaaggctgcgtcctaacgggcctctgggtcatcgcccacgaatgcggccaccacgccttcagcgactac

SEQ ID NO: 970 - DNA, 340 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggataactcaagaaagcaatcccacctcactgcttcaaacgctccatccctcgctccttctcctacctcctcttcgacatcctcgtctcctcctccctctaccacctctccacagcctacttccctctcctcccccacccgcctggcccctctactgggcctgccaaggctgcgtcctaacgggcctctgggtcatcgcccacgaatgcggccaccacgccttcagcgactac

SEQ ID NO: 971 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatctctcgctccttctcctacctcctcttcgacatcctcgtctcctcctccctctaccacctctccacagcctacttccctctcctcccccaccctctcccttacctggcccctctactgggcctgccaaggctgcgtcctaactggcctctgggtcatcgcccacgaatgcggccaccacgccttcagcgactac

SEQ ID NO: 972 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttccctctggcccctctactgggcctgccaaggctgcgtcctaacgggcctctgggtcatcgcccacgaatgcggccaccacgccttcagcgactac

SEQ ID NO: 973 - DNA, 352 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcctcaaacgctccatccctcgctccttctcctacctcctcttcgacatcctcgtctcctcctccctctaccacctctccacagcctacttccctctcctcccccaccctctcccttacctcgctggcccctctactgggcctgccaaggctgcgtcctaacgggcctctgggtcatcgcccacgaatgcggccaccacgccttcagcgactac

SEQ ID NO: 974 - DNA, 334 bp, Artificial
  Mutation in BnaC.FAD2.b introduced by TALE nuclease pair BnFAD2_T01
caggatccatgggtgcaggtcgaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctcccccaccctctcccttacctctactgggcctgccaaggctgcgtcctaacgggcctctgggtcatcgcccacgaatgcggccaccacgccttcagcgactac

SEQ ID NO: 975 - DNA, 327 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatcacacgctccttctcctcttcgacatcatcatctcctcctcggctcctccctctaccacctctccacagcctccttccctctcctccccctctactgggcctgccaaggctgcgtcctaacgggcctctgggtcatcgcccacgaatgcggccaccacgccttcagcgactac

SEQ ID NO: 976 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacccctctactgggcctgccaaggctgcgtcctaacgggcctctgggtcatcgcccacgaatgcggccaccacgccttcagcgactac

SEQ ID NO: 977 - DNA, 350 bp, Artificial
  Mutation in BnaC.FAD2.b introduced by TALE nuclease pair BnFAD2_T01
caggatccatgggtgcaggtggaagaatgcaagtctctcctccctcccgctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcacttaccgctggcccctctactgggcctgccaaggctgcgtcctaacgggcctctgggtcatcgcccacgaatgcggccaccacgccttcagcgactac

SEQ ID NO: 978 - DNA, 351 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctctggcccctctactgggcctgccaaggctgcgtcctaacgggcctctgggtcatagcccacgagtgcggccaccacgccttcagcgactac

SEQ ID NO: 979 - DNA, 350 bp, Artificial
  Mutation in BnaC.FAD2.b introduced by TALE nuclease pair BnFAD2_T01
caggatccatgggtgcagggggaagaatgcaagtgtctcctccctccaagaagtctgaaaccgacaccatcaagcgcgtaccctgcgagacaccgcccttcactgtcggagacctcaagaaagcaatcccacctcactgcttcaaacgctccatcccacgctccttctcctcttcgacatcatcatctcctcctcggctcctccctctaccacctctccacagcctacttccctctcctccccccccctctcccgtaccctggcccctctactgggccggccaaggctgcgtcctaactggcttctgggtcatcgccctcgaatgcggctgctgcgcctccatcgactcc

SEQ ID NO: 980 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccgtcgctccttctcctacctcctcttcgacatcctcgtctcctcctccctctaccacctctccacagccacgattgcggcaagcaggcgctggagcctggcccctctactgggcctgccaaggctgcgtcctaacgggcctctgggtcatagcccacgagtgcggccaccacgccttcagcgactac

SEQ ID NO: 981 - DNA, 344 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttggcccctctactgggcctgccaaggctgcgtcctaacgggcctctgggtcatcgcccacgaatgcggccaccacgccttcagcgactac

SEQ ID NO: 982 - DNA, 354 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgccctggcccctctactgggcctgccaaggctgcgtcctaacgggcctctgggtcatcgcccacgaatgctgccaccacgccttcagcgactcc

SEQ ID NO: 983 - DNA, 349 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 984 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctcttggtcatcgcccacgaatgcggccaccacgccttcagcgactac

SEQ ID NO: 985 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccccctctactgggcctgccaaggctgcgtcctaacgggcctctgggtcatagcccacgagtgcggccaccacgccttcagcgactac

SEQ ID NO: 986 - DNA, 346 bp, Artificial
  Mutation in BnaC.FAD2.b introduced by TALE nuclease pair BnFAD2_T01
caggatccatgggtgcaggtggaagaatgcaagtctctcctcccttcagctcccccgaaaacaaaaccctcaaacgcgtcccctgcgagacaccacccttcactctcggagacctcaagaaagcaatcccacctcactgcttcaaacgctccatccctcgctccttctcctacctcctcttcggcatcctcgtctcctcctccctctaccacctctccacagcctacttccctctcctcccccaccctctccctgacctcccctctactgggcctgccaaggctgcgtcctaacgggcctctgggtcatcgcccacgaatgctgccaccacgccttcagcgactac

SEQ ID NO: 987 - DNA, 261 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgccattcactctcggagacctcaagaaagcaatcccacctcactgcttcaaacgctccatccctcgctccttctcctcttcgacatcatcatctcctcctcggctcctccctctaccacctctccacagcctacttccctctcccttaccacgccttcagcgactac

SEQ ID NO: 988 - DNA, 260 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcccttaccacgccttcagcgactac

SEQ ID NO: 989 - DNA, 342 bp, Artificial
  Mutation in BnaC.FAD2.b introduced by TALE nuclease pair BnFAD2_T01
caggatccatgggtgcagggggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctccccttcgacatcctcgtctcctcctccctctaccacctctccacagccacgatggcggcaagcaggcgctggagcctggcccctctactgggcctgccaaggctgcgtcctaacgggcctctgggtcagcgcccacgaatgcggccaccacgccttcagcgactac

SEQ ID NO: 990 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctcgcctagcctggcctctctcctgggcctgccagggctgcgtcctaaccggcgtctgggtcatagcccacgagtgcggccaccacgccttcagcgactac

SEQ ID NO: 991 - DNA, 348 bp, Artificial
  Mutation in BnaC.FAD2.b introduced by TALE nuclease pair BnFAD2_T01
caggatccatgggtgcaggtgaaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctggcccctctactgggcctgccaaggctgcgtcctaacgggcctctgggtcatagcccacgagtgcggccaccacgccttcagcgactac

SEQ ID NO: 992 - DNA, 358 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctcgtctggcccctctactgggcctgccaaggctgcgtcctaacgggcctctgggtcatagcccacgagtgcggccaccacgccttcagcgactac

SEQ ID NO: 993 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgccctggcccctctactgggcctgccaaggctgcgtcctaacgggcctctgggtcatagcccacgagtgcggccaccacgccttcagcgactac

SEQ ID NO: 994 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 995 - DNA, 313 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctgtgcgtcctaaccggcgtcggggtcatagcccacgagtgcggccaccacgccttcagcgactac

SEQ ID NO: 996 - DNA, 348 bp, Artificial
  Mutation in BnaC.FAD2.b introduced by TALE nuclease pair BnFAD2_T01
caggatccatggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttcccttggcccctctactgggcctgccaaggctgcgtcctaacgggcctctgggtcatcgcccacgaatgcggccaccacgccttcagcgactac

SEQ ID NO: 997 - DNA, 412 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttcccccgctggagacgttccagcggctgttgccggtgctgtgccaggcccacggcttgcccccggagctggcccctctactgggcctgccaaggctgcgtcctaacgggcctctgggtcatagcccacgagtgcggccaccacgccttcagcgactac

SEQ ID NO: 998 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctcgcccttaccgcgccggccgctctacggggcctgccaaggctgcgtccgaacggggctatagggcagcgcccacgaatggggacacgaggccttcagcgactac

SEQ ID NO: 999 - DNA, 345 bp, Artificial
  Mutation in BnaC.FAD2.b introduced by TALE nuclease pair BnFAD2_T01
caggatccatgggtgcaggtggaagaatgcaagtgtctcctccctccagctcccccgaaaccaaaaccctcaaacgcgtcccctgcgagacaccaccattcactctcggagacatcaagaaagcaatcccacctcactgcttcaaacgctccatcccacgctccttctcctcttcgacatcatcatctcctcctccctctaccacctctccacagcctacttccctctcctcccccaccctctcccttacctccctggcccctctactgggcctgccaaggctgcgtcctaacgggcctctgggtcatcgcccacgaatgcggccaccacgccttcagcgactac

SEQ ID NO: 1000 - DNA, 348 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 1001 - DNA, 341 bp, Artificial
  Mutation in BnaC.FAD2.b introduced by TALE nuclease pair BnFAD2_T01
caggatccatgggtgcaggtggaagaatgcaagtgtctcctccctccagctcccccggaaccaacaccctcaaacgcgtcccctgcgagacaccacccttcactctcggagacctcaagaaagcaatcccacctcactgcttcaaacgctccatccctcgctccttctcctcttcgacatcatcatctcctcctcggctcctccctctaccacctctccacagcctacttccctctccctcaccctctctcctgcctctctactgggcctgccaagggtgcgtcctaaccggcgtctgggtcatagcccacgagtgcggccaccacgccttcagcgactac

SEQ ID NO: 1002 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccccccctggcccctctactgggcctgccaaggctgcgtcctaacgggcctctgggtcatcgcccacgaatgcggccaccacgccttcagcgactac

SEQ ID NO: 1003 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcacctctactgggcctgccaagggtgcgtcctaaccggcgtctgggtcatagcccacgagtgcggccaccacgccttcagcgactac

SEQ ID NO: 1004 - DNA, 342 bp, Artificial
  Mutation in BnaC.FAD2.b introduced by TALE nuclease pair BnFAD2_T01
caggatccatgggtgcaggtggaagaatgcaagtctatcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctccctctaccacctctccacagcctacttccctctcctcccccaccctctcccttaccttggcccctctactgggcctgccaaggctgcgtcctaacgggcctctgggtcatagcccacgagtgcggccaccacgccttcagcgactac

SEQ ID NO: 1005 - DNA, 356 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccgcctggcccctctactgggcctgccaaggctgcgtcctaacgggcctctgggtcatcgcccacgaatgcggccaccacgccttcagcgactac

SEQ ID NO: 1006 - DNA, 334 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctcccccaccctctcccttacctctactgggcctgccaaggctgcgtcctaacgggcctctgggtcatcgcccacgaatgcggccaccacgccttcagcgactac

SEQ ID NO: 1007 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaacctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctcacctggcccctctactgggcctgccaaggctgcgtcctaacgggcctctgggtcatcgcccacgaatgcggccaccacgccttcagcgactac

SEQ ID NO: 1008 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccccccccctcgcccttacccctggcccctctactgggcctgccaaggctgcgtcctaacgggcctctgggtcatagcccacgagtgcggccaccacgccttcagcgactac

SEQ ID NO: 1009 - DNA, 372 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgtgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctctccagcggctgttgccgccatcgtgcccctctactgggcctgccaaggctgcgtcctaacgggcctctgggtcatcgcccacgaatgcggccaccacgccttcagcgactac

SEQ ID NO: 1010 - DNA, 390 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccccctccccccaccctactcccctccccccccccccccccccccttccctcgccgcggcccctctacggggccggccagggctgcgcccaaccgggcctctgggtcatcgcccacgaaggcggccaccacgccttcaccgactac

SEQ ID NO: 1011 - DNA, 342 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagccacgatggcggcaagcaggcgctggagcctggcccctctactgggcctgccaaggctgcgtcctaacgggcctctgggtcatcgcccacgaatgcggccaccacgccttcagcgactac

SEQ ID NO: 1012 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttgccttggcccctctactgggcctgccaaggctgcgtcctaacgggcctctgggtcatcgcccacgaatgcggccaccacgccttcagcgactac

SEQ ID NO: 1013 - DNA, 355 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctccttcctggcccctctactgggcctgccaaggctgcgtcctaacgggcctctgggtcatcgcccacgaatgcggccaccacgccttcagcgactac

SEQ ID NO: 1014 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacttcctacttccctcccctccccccccctcccccttaccgcccctctactgggcctgccaaggctgcgtcctaacgggcctctgggtcatcgcccacgaatgcggccaccacgccttcagcgactac

SEQ ID NO: 1015 - DNA, 343 bp, Artificial
  Mutation in BnaC.FAD2.b introduced by TALE nuclease pair BnFAD2_T01
caggatccatgggtgcaggtggaagaatgcaagtctctcctccctccagctccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttggcccctctactgggcctgccaaggctgcgtcctaaccggcgtctgggtcatagcccacgagtgcggccaccacgccttcagcgactac

SEQ ID NO: 1016 - DNA, 346 bp, Artificial
  Mutation in BnaC.FAD2.b introduced by TALE nuclease pair BnFAD2_T01
caggatccatgggtgcaggtggcagaatgcaagtctatcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctgacctgccctctactgggcctgccaaggctgcgtcctaacgggcctcggtgtcatcgcccacgaatgcgtccaccacgccttcagcgactac

SEQ ID NO: 1017 - DNA, 346 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatccctcgctccttctcctacctcctcttcgacatcctcgtctcctcctccctctaccacctctccacagcctacttccctctcctccccccccctctcccttacctgccctctactgggcctgccaaggctgcgtcctaacgggcctctgggtcatcgcccacgaatgcggccaccacgccttcagcgactac

SEQ ID NO: 1018 - DNA, 338 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctccccccctctactgggccggccaaggctgcgtcctaacgggcctctgggtcatagcccacgagtgcggccaccacgccttcagcgactac

SEQ ID NO: 1019 - DNA, 354 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctccccccccctctcccttacctccgcctggcccctctactgggcctgccaaggctgcgtcctaacgggcctctgggtcatagcccacgagtgcggccaccacgccttcagcgactac

SEQ ID NO: 1020 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccacccgctcccttacctctactgggcctgccaaggctgcgtcctaacgggcctctgggtcatcgcccacgaatgcggccaccacgccttcagcgactac

SEQ ID NO: 1021 - DNA, 338 bp, Artificial
  Mutation in BnaC.FAD2.b introduced by TALE nuclease pair BnFAD2_T01
caggatccatgggtgcaggtgcaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttacccgcctgacccctctactgggcctgccaaggctgcgtcctaacgggcctctgggtcatagcccacgagtgcggccaccacgccttcagcgactac

SEQ ID NO: 1022 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttccctcgcccctctactgggcctgccaaggctgcgtcctaacgggcctctgggtcatcgcccacgaatgcggccaccacgccttcagcgactac

SEQ ID NO: 1023 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctcccctgcctctctactgggcctgccaagggtgcgtcctaaccggcttctgggtcatagcccacgagggcggccaccacgccttcagcgactac

SEQ ID NO: 1024 - DNA, 337 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccctctactgggcctgccaaggctgcgtcctaacgggcctctgggtcatcgcccacgaatgcggccaccacgccttcagcgactac

SEQ ID NO: 1025 - DNA, 429 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctccccccccctctcccttccctccccagcggctgttgccggtgctgtgccaggcccacggcttgacccctcagcaggtggtggccatcgccagccacgatggtggcccctctactgggcctgccaaggctgcgtcctaacgggcctctgggtcatcgcccacgaatgcggccaccacgccttcagcgactac

SEQ ID NO: 1026 - DNA, 353 bp, Artificial
  Mutation in BnaC.FAD2.b introduced by TALE nuclease pair BnFAD2_T01
caggatccatgggtgcaggtggaagaatgcaagtctctcatccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctactgcactagcctctctactgggcctcccatggctgctgccgaaccggcgtcgaggacatagcccacgagtgcgtccaccacaccaacagcgactac

SEQ ID NO: 1027 - DNA, 480 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcctcccctcccccccccccccctctcccttccctcgcctgctgccgatggccacccccggctccggggtcaagccgtgggcctggcacagcaccggggcggcgtgaccgcagtggaggcagtgcatgcatggcgctcgcctggcccctctactgggcctgccagggctgcgtcctaaccggcgtctgggtcatagcccacgagtgcggccaccacgccttcagcgactac

SEQ ID NO: 1028 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccatctactgggcctgccaagggtgcgtcctaaccggcgtctgggtcatagcccacgagtgcggccaccacgccttcagcgactac

SEQ ID NO: 1029 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacccctggcccctctactgggcctgccaaggctgcgtcctaacgggcctctgggtcatcgcccacgaatgcggccaccacgccttcagcgactac

SEQ ID NO: 1030 - DNA, 300 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcatctgggacatcatcatagcctcctgcttctactacgtctctctactgggcctgccaaggctgcgtcctaacgggcctctgggtcatcgcccacgaatgcggccaccacgccttcagcgactac

SEQ ID NO: 1031 - DNA, 312 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagacctcaagaaagcaatcccacctcactgcttcaaacgctccatccctcgctccttctcctacctcctcttcgacatcctcgtctcctcctccctctaccacctctccacagcctacttccctctgggtctgccaaggctgcgtcctaacgggcctctgggtcatcgcccacgaatgcggccaccacgccttcagcgactac

SEQ ID NO: 1032 - DNA, 338 bp, Artificial
  Mutation in BnaC.FAD2.b introduced by TALE nuclease pair BnFAD2_T01
caggatccatgggtgcaggcggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctctctctactgggcctgccaagggtgcgtcctaacgggcctctgggtcatcgcccacgaatgcggccaccacgccttcagcgactac

SEQ ID NO: 1033 - DNA, 346 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttatggcccctctactgggcctgccaaggctgcgtcctaacgggcctctgggtcatcgcccacgaatgcggccaccacgccttcagcgactac

SEQ ID NO: 1034 - DNA, 340 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctctctactgggcctgccagggctgcgtcctaaccggcgtctgggtcatagcccacgaatgcggccaccacgccttcagcgactac

SEQ ID NO: 1035 - DNA, 348 bp, Artificial
  Mutation in BnaC.FAD2.b introduced by TALE nuclease pair BnFAD2_T01
caggatccatgggtgcaggtggcagaatgcaagtgtctcctccctccaaaaagtctgaaaccgacaacatcaagcgcgtaccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttggcctctctactgggcctgccaagggtgcgtcctaaccggcgtctgggtcatagcccacgagtgcggccaccacgccttcagcgactac

SEQ ID NO: 1036 - DNA, 344 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttggcccctctactgggcctgccaaggctgcgtcctaacgggcctctgggtcatcgcccacgaatgcggccaccacgccttcagcgactac

SEQ ID NO: 1037 - DNA, 348 bp, Artificial
  Mutation in BnaC.FAD2.b introduced by TALE nuclease pair BnFAD2_T01
caggatccatgggtgcaggtggaagaatgcaagtctctcctccctccagcccccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatagcccacgagtgcggccaccacgccttcagcgactac

SEQ ID NO: 1038 - DNA, 336 bp, Artificial
  Mutation in BnaC.FAD2.b introduced by TALE nuclease pair BnFAD2_T01
caggatccatgggtgcaggtagaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctgggcctgccaaggctgcgtcctaacgggcctctgggtcatcgcccacgaatgcggccaccacgccttcagcgactac

SEQ ID NO: 1039 - DNA, 358 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctcgcctcgtctggcccctctactgggcctgccaaggctgcgtcctaacgggcctctgggtcatcgcccacgaatgcggccaccacgccttcagcgactac

SEQ ID NO: 1040 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatagcccacgagtgtggccaccacgccttcagcgactac

SEQ ID NO: 1041 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccttctcctcccccaccctctcccttacctctggcccctctactgggcctgccaaggctgcgtcctaacgggcctctgggtcatcgcccacgaatgcggccaccacgccttcagcgactac

SEQ ID NO: 1042 - DNA, 331 bp, Artificial
  Mutation in BnaC.FAD2.b introduced by TALE nuclease pair BnFAD2_T01
caggatccatgggtgcaggtagaagaatgcaagtctctcctccctccagctcccccgaaaacaaaaccctcaaacacgtcccatgcgagacaccacccttcactctcggagacctcaagaaagcaatcccacctcactgcttcaaacgctccatccctcgctccttctcctacctcctcgtcgacatcctcgtctcctcctccctctaccacctctccacagcctacttccctctcctccctggcccctctactggtcctgccaaggctgcgtcctaacgggcctctgggtcatagcccacgagggctgccgccacgccttcagcgactac

SEQ ID NO: 1043 - DNA, 314 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcccccaccctctcccttacctccgcctggcccctctactgggcctgccaaggctgcgtcctaacgggcctctgggtcatcgcccacgaatgcggccaccacgccttcagcgactac

SEQ ID NO: 1044 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttccctcgcccctctactgggcctgccaaggctgcgtcctaacgggcctctgggtcatagcccacgagtgcggccaccacgccttcagcgactac

SEQ ID NO: 1045 - DNA, 323 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttcgcctggcccctctactgggcctgccaaggctgcgtcctaacgggcctctgggtcatcgcccacgaatgcggccaccacgccttcagcgactac

SEQ ID NO: 1046 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaaccagtcccctgcgagacaccacccttcactctcggagccctcaagaaagcaatcccacctcactgcttcaaacgctccatccctcgctccttctcctacctcctcttcgacatcctcgtctcctcctccctctaccacctctccacagcctacttccctcccctccccccccctctcccttcccccgcctctactgggcctgccaaggctgcgtcctaacgggcctctgggtcatcgcccacgaatgtggccaccacgccttcagcgactac

SEQ ID NO: 1047 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctgcccctctactgggcctgccaaggctgcgtcctaacgggcctctgggtcatcgcccacgaatgcggccaccacgccttcagcgactac

SEQ ID NO: 1048 - DNA, 350 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatcccacgctccttctcctcttcgacatcatcatctcctcctcggctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 1049 - DNA, 337 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttacctcgcctggccctctactgggcctgccaaggctgcgtcctaaccggcgtctgggtcatagcccacgagtgcggccaccacgccttcagcgacta

SEQ ID NO: 1050 - DNA, 349 bp, Artificial
  Mutation in BnaC.FAD2.b introduced by TALE nuclease pair BnFAD2_T01
caggatccatgggtgcaggtggcagaatgcaagtctctactccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacgttggcctctctactgggcctgccaagggtgcgtccgaaccggcgtctgggtcatatcccacgagtgctgccaccacgccttcagcgactac

SEQ ID NO: 1051 - DNA, 338 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctctttctcctacctcatcttcgacatcctcgtctcctcctccctctaccacctctccacagcctacttccctctcctcccccgccctctccccctctactgggcctgccaaggctgcggcctaacgtgcctctgggtcatagcccacgagtgcggcctccacgccttcagcgactac

SEQ ID NO: 1052 - DNA, 349 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctactcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 1053 - DNA, 336 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctcccccaccctctcccttacccctctactgggcctgccaagggtgcgtcctaacgggcctctgggtcatagcccacgagtgcggccaccacgccttcagcgactac

SEQ ID NO: 1054 - DNA, 381 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttccctcgctcgccgcagccgaacgaccgagcgcagcgtggcccctctactgggcctgccaaggctgcgtcctaacgggcctctgggtcatcgcccacgaatgcggccaccacgcctgcagcgactac

SEQ ID NO: 1055 - DNA, 413 bp, Artificial
  Mutation in BnaC.FAD2.b introduced by TALE nuclease pair BnFAD2_T01
caggatccatgggtgcaggtggaagaatgcaagtctctcctccctccagctccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccccccgctctcctactccgccggcaaaaccgcgccgaaggatgtcgctgccgactgggcaatggagcgcctgccggcccacctggcctctctactgggcctgccaaggctgcgtcctaacgggcctctgggtcatagcccacgagtgcggccaccacgccttcagcgactac

SEQ ID NO: 1056 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctccgcctggcccctctactgggcctgccaaggctgcgtcctaacgggcctctgggtcatcgcccacgaatgcggccaccacgccttcagcgactac

SEQ ID NO: 1057 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcccctctactgggcctgccaaggctgcgtcctaacgggcctctgggtcatagcccacgagtgcggccaccacgccttcagcgactac

SEQ ID NO: 1058 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctgcccctctactgggcctgccaaggctgcgtcctaacgggcctctgggtcatagcccacgagtgcggccaccacgccttcagcgactac

SEQ ID NO: 1059 - DNA, 349 bp, Artificial
  Mutation in BnaC.FAD2.b introduced by TALE nuclease pair BnFAD2_T01
caggatccatgggtgcaggcggaagaatgcaagtatctcctcccaccagctcccccgaaaccaaaaccctcaaacgcgtcccctgcgagacaccacccttcactcgcggagacctcaagaaagcaatcccacctcactgcttcaaacgctccatccctcgctccttctcctacctcctcttcgacatcctcgtctcctcctccctctaccacctctccacagcctacttcccgctcctcccccaccctctcccgtaccttggcccctctactgggccggccaaggctgcgtcctaacgggcgtctgggtcatagcccacgagggcggccaccacgccatcagcgactac

SEQ ID NO: 1060 - DNA, 340 bp, Artificial
  Mutation in BnaC.FAD2.b introduced by TALE nuclease pair BnFAD2_T01
caggatccatgggtgcaggtggaagaatgcaagtctctcctccctccagctcccacggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctccctctactgggcctgccaaggctgcgtcctaacgggcctctgggtcatagcccacgagtgcggccaccacgccttcagcgactac

SEQ ID NO: 1061 - DNA, 351 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctccccctttcctctggcccctctactgggcctgccaaggctgcgtcctaacgggcctctgggtcatcgcccacgaatgcggccaccacgccttcagcgactac

SEQ ID NO: 1062 - DNA, 344 bp, Artificial
  Mutation in BnaC.FAD2.b introduced by TALE nuclease pair BnFAD2_T01
caggatccattggtgcaggtggaagaatgcaagtatctcatccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcgcctggcccctctactgggcctgccaaggctgcgtcctaacgggcctctgggtcatcgcccacgaatgcggccaccacgccttcagcgactac

SEQ ID NO: 1063 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttccacatcctcgtctcctcctccctctaccacctctccacagcctacttccctctcctcccccaccctctcccttacccctctactgggcctgccaaggctgcgtcctaacgggcctctgggtcatcgcccacgaatgcggccaccacgcctcagcgactac

SEQ ID NO: 1064 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctgccccctctactgggcctgccaaggctgcgtcctaacgggcctctgggtcatagcccacgagtgcggccaccacgccttcagcgactac

SEQ ID NO: 1065 - DNA, 349 bp, Artificial
  Mutation in BnaC.FAD2.b introduced by TALE nuclease pair BnFAD2_T01
caggatccatgggtgcaggtggcagaatgcaagtctctactccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 1066 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacgtgcctctgggtcatagcccacgagtgcggccaccacgccttcagcgactac

SEQ ID NO: 1067 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctccctctaccacctctccacagcctacttccctctcctcccccaccctctcccttacctcgccctggcccctctactgggcctgccaaggctgcgtcctaacgggcctctgggtcatcgcccacgaatgcggccaccacgccttcagcgactac

SEQ ID NO: 1068 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctggcccctctactgggcctgccaaggctgcgtcctaacgggcctctgggtcatcgcccacgaatgcggccaccacgccttcagcgactac

SEQ ID NO: 1069 - DNA, 352 bp, Artificial
  Mutation in BnaC.FAD2.b introduced by TALE nuclease pair BnFAD2_T01
caggatccatgggtgcaggtggaagaatgcaagtctatcctccctccagctcccccgaaaccaaaaccctcaaacgcgtcccctgcgagacaccacccttcactctcggagacctcaagaaagcaatcccacctcactgcttcaaacgctccatacctcgctccttctcctacctcctcttcgacatcctcgtctcctcctccctctaccacctctccacagcctacttccctctcctccctcaccctctctcctacttcgctggcctctctactgggcctgccaagggtgcgtcctaaccggcgtctgggtcatagcccacgagtgctgcctcctcgccttcagcgactac

SEQ ID NO: 1070 - DNA, 338 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttacctcgcctacccctctactgggcctgccaaggctgcgtcctaacgggcctctgggtcatagcccacgagtgcggccaccacgccttcagcgactac

SEQ ID NO: 1071 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttatggcccctctactgggcctgccaaggctgcgtcctaacgggcctctgggtcatcgcccacgaatgcggccaccacgccttcagcgactac

SEQ ID NO: 1072 - DNA, 358 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctcgtctggcccctctactgggcctgccaaggctgcgtcctaacgggcctctgggtcatcgcccacgaatgcggccaccacgccttcagcgactac

SEQ ID NO: 1073 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccacgcctctactgggcctgccaaggctgcgtcctaacgggcctctgggtcatcgcccacgaaggcggccaccacgccttcagcgactacc

SEQ ID NO: 1074 - DNA, 357 bp, Artificial
  Mutation in BnaC.FAD2.b introduced by TALE nuclease pair BnFAD2_T01
caggatccatgggtgcagggggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctcccctcccccaccctctcccttacctcgccacctggccccgctactgggccggccaaggctgcgtcctaacgggcctctgggtcatcgcccacgaatgcggccaccacgccttcagcgactac

SEQ ID NO: 1075 - DNA, 342 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatcccacgctccttctcctcttcgacatcatcatctcctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 1076 - DNA, 328 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctccctcaccctctctcctactgggcctgccagggctgcgtcctaaccggcgtctgggtcatagcccacgagtgcggccaccacgccttcagcgactac

SEQ ID NO: 1077 - DNA, 354 bp, Artificial
  Mutation in BnaC.FAD2.b introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccctggcccctctactgggcctgccaaggctgcgtcctaacgggccgctgggtcatcgcccacgaaggcggccaccacgccttcagcgactac

SEQ ID NO: 1078 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccacctcactgcttcaaacgctccatcccacgctccttctcctcttcgacatcctcgtctcctcctccctctaccacctctccacagcctacttccctctcctcccccaccctctcccttacctcgccctggcccctctactgggcctgccaaggctgcgtcctaacgggcctctgggtcatcgcccacgaatgcggccaccacgcattcagcgactac

SEQ ID NO: 1079 - DNA, 350 bp, Artificial
  Mutation in BnaC.FAD2.b introduced by TALE nuclease pair BnFAD2_T01
caggatccatgggtgcaggtggaagaatgcaagtctctactccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacccctggcccctctactgggcctgccaaggcggcgtcctaacgggcctctgggtcatcgcccacgaatgcggccaccacgcctgcagcgactac

SEQ ID NO: 1080 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcccctctactgggcctgccaaggctgcgtcctaacgggcctctgggtcatcgcccacgaatgcggccaccacgccttcagcgactac

SEQ ID NO: 1081 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctcgccctggcccctctactgggcctgccaaggctgcgtcctaacgggcctctgggtcatcgcccacgaatgcggccaccacgccttcagcgactac

SEQ ID NO: 1082 - DNA, 334 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatcccacgctccttctcctcttcgacatcatcatctcctcctcggctcctccctctaccacctctccacagcctacttccctctcccttacctggcccctctactgggcctgccaaggctgcgtcctaacgggcctctgggtcatcgcccacgaatgcggccaccacgccttcagcgactac

SEQ ID NO: 1083 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctctcctacctggcctctctactgggcctgccagggctgcgtcctaaccggcgtctgggtcatagcccacgagtgcggccaccacgccttcagcgactac

SEQ ID NO: 1084 - DNA, 332 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctactgggcctgccaagggtgcgtcctaaccggcgtctgggtcatagcccacgagtgcggccaccacgccttcagcgactac

SEQ ID NO: 1085 - DNA, 376 bp, Artificial
  Mutation in BnaC.FAD2.b introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccacctcactgcttcaaacgctccatcccacgctccttctcctcttcgacatcatcatctcctcctcgtctcctcctccctctaccacctctccacagcctacttccctctcctcccccaccctctcccttacctctccagcggcggttgccgccatcgtgcccctctactgggcctgccaaggctgcgtcctaacgggcctctgggtcatcgcccacgagtgcggccaccacgccttcagcgactac

SEQ ID NO: 1086 - DNA, 344 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaggcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttggcccctctactgggcctgccaaggctgcgtcctaacgggcctctgggtcatcgcccacgaatgcggccaccacgccttcagcgactac

SEQ ID NO: 1087 - DNA, 304 bp, Artificial
  Mutation in BnaC.FAD2.b introduced by TALE nuclease pair BnFAD2_T01
caggatccatgggtgcaggtggcagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctcaccctctctcctactttactgggcctgccaagggtgcgtcctaaccggcgtctgggtcatagcccacgattgcggccaccacgccttcagcgactac

SEQ ID NO: 1088 - DNA, 355 bp, Artificial
  Mutation in BnaC.FAD2.b introduced by TALE nuclease pair BnFAD2_T01
caggatccatgggtgcaggtggaagaatgcaagtctctcctccctcccgctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctccccccccctctcccttaccgcgcgcctggcccctctactgggcctgccaaggctgcgtcctaacgggcctctgggtgatagcccacgagtgcggccaccaggcctgcagcgactac

SEQ ID NO: 1089 - DNA, 355 bp, Artificial
  Mutation in BnaC.FAD2.b introduced by TALE nuclease pair BnFAD2_T01
caggatccatgggtgcaggtggaagaatgcaagtctctcctccatccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctcgcgcctggcccctctaatgggcctgccaaggctgcgtcctaacgggcctctgggtcatcgcccacgaatgcggccaccacgccttcagcgactac

SEQ ID NO: 1090 - DNA, 323 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttcgcctggcctctctactgggcctgccaaggctgcgtcctaacgggcctctgggtcatcgcccacgaatgcggccaccacgccttcagcgactac

SEQ ID NO: 1091 - DNA, 350 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccaccaagcgcgtaccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacccctggcccctctactgggcctgccaaggctgcgtcctaacgggcctctgggtcatcgcccacgaatgcggccaccacgccttcagcgactac

SEQ ID NO: 1092 - DNA, 352 bp, Artificial
  Mutation in BnaC.FAD2.b introduced by TALE nuclease pair BnFAD2_T01
caggatccatgggtgcaggtggcagaatgcaagtctctactccctcccgctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggccctctactgcgcctgccaaggctgcgtcctaacgggcctctgggtcatcgcccacgaatgcggccacgacgcctgcagcgactac

SEQ ID NO: 1093 - DNA, 381 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccccctcactgcttcaaacgctccatccctcgctccttctcctacctcctctgggacatcatcatagcctcctgcttctactacgtcgccaccacttacttccctctcctcccccaccctctccctccccccgctcgccgcagccgaacgaccgagcgccgcgtggcccctctactgggcctgccaaggctgcgtcctaacgggcctctgggtcatcgcccacgaatgcggccaccacgccttcagcgactac

SEQ ID NO: 1094 - DNA, 332 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatcccacgctccttctcctcttcgacatcatcatctcctcctcggctcctccctctaccacctctccacagcctacttccctctcctccctggcccctctactgggcctgccaaggctgcgtcctaacgggcctctgggtcatcgcccacgaatgcggccaccacgccttcagcgactac

SEQ ID NO: 1095 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcccctctactgggcctgccaaggctgcgtcctaaccggcgtctgggtcatagcccacgagtgcggccaccacgccttcagcgactac

SEQ ID NO: 1096 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacccctctactgggcctgccaaggctgcgtcctaacgggcctctgggtcatagcccacgagtgcggccaccacgccttcagcgactac

SEQ ID NO: 1097 - DNA, 336 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgccattcactctcggagacctcaagaaagcaatcccacctcactgcttcaaacgctccatcccacgctccttctcctcttcgacatcatcatctcctcctccctctaccacctctccacagcctacttccctctcctcccccaccctctcccttacccctctactgggcctgccaaggctgcgtcctaacgggcctctgggtcatcgcccacgaatgcggccaccacgccttcagcgactac

SEQ ID NO: 1098 - DNA, 331 bp, Artificial
  Mutation in BnaC.FAD2.b introduced by TALE nuclease pair BnFAD2_T01
caggatccatgggtgcaggtgcaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctggcccctctactgggcctgccaaggctgcgtcctaacgggcctctgggtcatcgcccacgaatgcggccaccacgcctgcagcgactac

SEQ ID NO: 1099 - DNA, 451 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttcccccggccttgatcatctcgccgccgatcaggagctcctccacggacagcacggcgccgtttcgttttatttgatgcctggcagttccctactctcgcgttcgaatacatctagatccaagcctgccaaggctgcgtcctaacgggcctctgggtcatcgcccacgaatgcggccaccacgccttcagcgactac

SEQ ID NO: 1100 - DNA, 308 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcccccaccctctcccttacctcgcccctctactgggcctgccaaggctgcgtcctaacgggcctctgggtcatagcccacgagtgcggccaccacgccttcagcgactac

SEQ ID NO: 1101 - DNA, 388 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcggtccagcgcctgcttgccaccattattgctggcgatggccaccacctgctgggcctgccaaggctgcgtcctaacgggcctctgggtcatcgcccacgaatgcggccaccacgccttcagcgactac

SEQ ID NO: 1102 - DNA, 311 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctcaccctctctcctacttgcctctctactgggcctgccagggctgcgtcctaaccggcctctgggtcatagcccacgagtgcggccaccacgccttcagcgactac

SEQ ID NO: 1103 - DNA, 349 bp, Artificial
  Mutation in BnaC.FAD2.b introduced by TALE nuclease pair BnFAD2_T01
caggatccatgggtgcaggtggaagaatgcaagtctttcttccctccagctcccccgaaaccaaaaccctcaaacgcgtcccctgcgagacatcacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttgacccctctactgggcctgccaaggctgcgtcctaaccggcgtctgggtcatagcccacgagtgcggccaccacgccatcagcgactac

SEQ ID NO: 1104 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctgccctctactgggcctgccaaggctgcgtcctaacgggcctctgggtcatagcccacgagtgcggccaccacgccttcagcgactac

SEQ ID NO: 1105 - DNA, 345 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgtgagacaccacccttcactctcggagacctcaagaaagcaatcccacctcactgcttcaaacgctccatccctcgctccttctcctacctcctcttcgacatcctcgtctcctcctccctctaccacctctccacaccctacttccctctcctccctccccctctccccctggcctctctactgggcctgccaaggctgcgtcctaacgggcctctgggtcatagcccacgagtgcggccaccacgccttcagcgactac

SEQ ID NO: 1106 - DNA, 346 bp, Artificial
  Mutation in BnaC.FAD2.b introduced by TALE nuclease pair BnFAD2_T01
caggatccatgggtgcaggtggaagaatgcaagtctctcctcccttcagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccccctctccacagcctacttccctctcctcccccaccctctcccttacctgccctctactgggcctgccaaggctgcgtcctaacgggcctctgggtcatagcccacgagtgcggccaccacgccttcagcgactac

SEQ ID NO: 1107 - DNA, 346 bp, Artificial
  Mutation in BnaC.FAD2.b introduced by TALE nuclease pair BnFAD2_T01
caggatccatgggtgcaggtggaagaatgcaagtatctcctccctccagctcccccgaaaccaaaaccctcaaacgcgtcccctgcgagacaccaccattcactctcggagacctcaagaaagcaatcccacctcactgcttcaaacgctccatccctccctccttctcccacctcctcttcgacatcctcgtctcctcctccctctaccacctctccacagcctacttccctctcctcccccaccctcacccgtatggcccctctactgggcctgccaaggctgcgtcctaacgggcctctgggtcatcgcccacgaatgctgccaccacgccgtcagcgactac

SEQ ID NO: 1108 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggccatcctcgcctcctcctccctctaccccccctccacagcctacttccctctcctccccctccctctcccttacccctctactgggcctgccaaggctgcgtcctaacgggcctctgggtcatcgcccacgaatgcggccaccacgccttcagcgactac

SEQ ID NO: 1109 - DNA, 355 bp, Artificial
  Mutation in BnaC.FAD2.b introduced by TALE nuclease pair BnFAD2_T01
caggatccatgggtgcaggtggaagaatgcaagtctctactccctccagctcccccgaaaccaaaaccctcaaacgcatcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctccccccccaccctctccctgacctccttcctggcccctctacagggccggccaaggcggcgtcctaacgggcctctgggtcatcgcccacgaatgcggccaccacgccttcagcgactac

SEQ ID NO: 1110 - DNA, 430 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctctccagcggctgttgccggtgctgggccaggcccacggcttgaccccggagcaggtggtggccatcgccagccacgatggtggcccctctactgggcctgccaaggctgcgtcctaacgggcctctgggtcatcgcccacgaatgcggccaccacgccttcagcgactac

SEQ ID NO: 1111 - DNA, 354 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccctggcccctctactgggcctgccaaggctgcgtcctaacgggcctctgggtcatcgcccacgaatgcggccaccacgccttcagcgactac

SEQ ID NO: 1112 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctgggcctgccaaggctgcgtcctaacgggcctctgggtcatagcccacgagtgcggccaccacgccttcagcgactac

SEQ ID NO: 1113 - DNA, 347 bp, Artificial
  Mutation in BnaC.FAD2.b introduced by TALE nuclease pair BnFAD2_T01
caggatccatgggtgcaggtggcagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacggcctctgggtcatagcccacgagtgcggccaccacgccttcagcgactac

SEQ ID NO: 1114 - DNA, 373 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctcccacctctccacagcctacttccctctcctccccccccctctcccttacccctccagcgcctgcttgccgccatcgtgcccctctactgggcctgccaaggctgcgtcctaacgggcctctgggtcatagcccacgagtgcggccaccacgccttcagcgactac

SEQ ID NO: 1115 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctccctggcccctctactgggcctgccaaggctgcgtcctaacgggcctctgggtcatcgcccacgaatgcggccaccacgccttcagcgactac

SEQ ID NO: 1116 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcatcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 1117 - DNA, 346 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttatggcccctctactgggcctgccaaggctgcgtcctaacgggcctctgggtcatcgcccacgaatgctgccaccacgccttcagcgactac

SEQ ID NO: 1118 - DNA, 338 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctccccctctactgggcctgccaaggctgcgtccaacgggcctctgggtcatcgcccacgaatgcggccaccacgccttcagcgactac

SEQ ID NO: 1119 - DNA, 340 bp, Artificial
  Mutation in BnaC.FAD2.b introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctccctctactgggcctgccaaggctgcgtcctaacgggcctctgggtcatcgcccacgaatgcggccaccacgccttcagcgactac

SEQ ID NO: 1120 - DNA, 349 bp, Artificial
  Mutation in BnaC.FAD2.b introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacctcatcatctcctcctcggctcctccctctaccacctctccacagcctacttccctctcctccccccccccctccctcgcctggaccccccaacggggcctgccaaggctgcgccccaacgggcctctgggtcataccccacgagtgcggccaccacgccttcaggactac

SEQ ID NO: 1121 - DNA, 342 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagccacgatggcggcaagcaggcgctggagcctggcccctctactgggcctgccaaggctgcgtcctaacgggcctctgggtcatcgcccacgaatgcggccaccacgccttcagcgactac

SEQ ID NO: 1122 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccctggcccctctactgggcctgccaaggctgcgtcctaacgggcctctgggtcatcgcccacgaatgcggccaccacgccttcagcgactac

SEQ ID NO: 1123 - DNA, 312 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgcttcaaacgctccatccctcgctccttctcctacctcctcttcgacatcctcgtctcctcctccctctaccacctctccacagcctacttccctctgggtctgccaaggctgcgtcctaacgggcctctgggtcatcgcccacgaatgcggccaccacgccttcagcgactac

SEQ ID NO: 1124 - DNA, 350 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 1125 - DNA, 307 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctcaccctctctcctacttctctactgggcctgccagggctgcgtcctaaccggcgtctgggtcatagcccacgagtgcggccaccacgccttcagcgactac

SEQ ID NO: 1126 - DNA, 480 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccccctctccacagcctccttcccccccctccccccccctcccagcccccccccccccccccccccaccctcccccttccccggctggcgatgcccaccacctgctccggggtcaagccgtgggcctggcacagcaccgccaacagccgctggaccgtctccagcgcctgcttgccgccatctggcccctctactgggcctgccaaggctgcgtcctaacgggcctctgggtcatcgcccacgaatgcggccaccacgccttcagcgactac

SEQ ID NO: 1127 - DNA, 373 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctccagcgcctgcttgccgccatcgtgcccctctactgggcctgccaaggctgcgtcctaacgggcctctgggtcatcgcccacgaaggcggccaccacgccttcagcgactac

SEQ ID NO: 1128 - DNA, 342 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagccacgatggcggcaagcaggcgctggagcctggcccctctactgggcctgccaaggctgcgtcctaacgggcctctgggtcatcgcccacgaatgcggccaccacgcctgcagcgactac

SEQ ID NO: 1129 - DNA, 349 bp, Artificial
  Mutation in BnaC.FAD2.b introduced by TALE nuclease pair BnFAD2_T01
caggatccatgggtgcaggtggcagaatgcaagtgtctcctccctccaagaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 1130 - DNA, 350 bp, Artificial
  Mutation in BnaC.FAD2.b introduced by TALE nuclease pair BnFAD2_T01
caggatccatgggtgcaggtggaagaatgcaagtatctcctccctccagctcccccggaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 1131 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccctggcccctctactgggcctgccaaggctgcgtcctaacgggcctctgggtcatagcccacgagtgcggccaccacgccttcagcgactac

SEQ ID NO: 1132 - DNA, 349 bp, Artificial
  Mutation in BnaC.FAD2.b introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcggcctctctactgggcctgccaagggtgcgtcctaaccggcgtctgggtcatagcccacgagtgcggccaccacgccttcagcgactac

SEQ ID NO: 1133 - DNA, 348 bp, Artificial
  Mutation in BnaC.FAD2.b introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctccccctcacctcgcccctctactgggcctgccaaggctgcgtcctaacgggcctctgggtcatagcccacgagtgcggccaccacgccttcagcgactac

SEQ ID NO: 1134 - DNA, 314 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctactcttcgacatcatcatctcctcctcggctcctcccccaccctctcccttacctctggcccctctactgggcctgccaaggctgcgtcctaacgggcctctgggtcatcgcccacgaatgcggccaccacgccttcagcgactac

SEQ ID NO: 1135 - DNA, 331 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctctccgacatcctcgtctcctcctccctctaccccctctccacagcctacttccctctcctccctggcccctctactgggcctgccaaggctgcgtcctaacgggcctctgggtcatagcccacgagtgcggccaccacgccttcagcgactac

SEQ ID NO: 1136 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctcgcccttacccctctactgggcctgccaaggctgcgtcctaaccggcgtctgggtcatagcccacgagtgcggccaccacgccttcagcgactac

SEQ ID NO: 1137 - DNA, 351 bp, Artificial
  Mutation in BnaC.FAD2.b introduced by TALE nuclease pair BnFAD2_T01
caggatccatgggtgcaggtggcagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcggggcctctctactgggcctgccaagggtgcgtcctaaccggcgtctgggtcatagcccacgagtgcggccgcgacgccttcagcgactac

SEQ ID NO: 1138 - DNA, 354 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgccctggcccctctactgggcctgccaaggctgcgtcctaacgggcctctgggtcatcgcccacgaatgcggccaccacgccttcagcgactac

SEQ ID NO: 1139 - DNA, 327 bp, Artificial
  Mutation in BnaC.FAD2.b introduced by TALE nuclease pair BnFAD2_T01
caggatccatgggtgcaggtggaagaatgcaagtgtctcctccctccagctcccccggaaccaacaccctcaaacgcgtcccctgcgagacaccacccttcactctcggagacctcaagaaagcaatcccacctcactgcttcaaacgctccatcccacgctccttctcctcttcgacatcatcatctcctcctctgctcctccctctacctcctctccccagcctacttccctctcctccccctctactgggcctgccaaggctgcgtcctaacgggcctctgggtcatcgcccacgaatgcggccaccacgccttcagcgactac

SEQ ID NO: 1140 - DNA, 349 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 1141 - DNA, 346 bp, Artificial
  Mutation in BnaC.FAD2.b introduced by TALE nuclease pair BnFAD2_T01
caggatccatgggtgcaggtggcagaatgcaagtgtctcctccctcccaaaagtctgaaaccgacaacatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcccctctactgggcctgccaaggctgcgtcctaacgggcctctgggtcatcgcccacgaatgcggccaccacgccttcagcgactac

SEQ ID NO: 1142 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctctggcccctctactgggcctgccaaggctgcgtcctaacgggcctctgggccatcgcccacgaatgcggccaccacgccttcagcgactac

SEQ ID NO: 1143 - DNA, 331 bp, Artificial
  Mutation in BnaC.FAD2.b introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctccctcaccctctctcctactactgggcctgccaagggtgcgtcctaaccggcgtctgggtcatagcccacgagtgcggccaccacgccttcagcgactac

SEQ ID NO: 1144 - DNA, 350 bp, Artificial
  Mutation in BnaC.FAD2.b introduced by TALE nuclease pair BnFAD2_T01
caggatccatgggtgcaggtgccagaatgcaagtttctactcactccagctcccccgaaaccaaaaccctcaaacgcgtcccctgcgagacaccacccttcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctctggcccctctactgggcctgccaaggctgcgtgctaacgggcctctgggtcatagcccacgagtgcggcctccacgcctgcagtgactac

SEQ ID NO: 1145 - DNA, 350 bp, Artificial
  Mutation in BnaC.FAD2.b introduced by TALE nuclease pair BnFAD2_T01
caggatccatgggtgcaggtgcaagaatgcaagtctctcctccctacagctccaccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaactggcctcttggtcatcgcccacgaatgcggccaccacgccagcagcgactac

SEQ ID NO: 1146 - DNA, 350 bp, Artificial
  Mutation in BnaC.FAD2.b introduced by TALE nuclease pair BnFAD2_T01
caggatccatgggtgcaggtggaagaatgcaagtttctactcccttcagctcccccgaaaccaaaacactcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttgccgctggcccctctactgggcctgccaaggcttcgtcctaacgggcctctgggtcatcgcccacgaatgcgggctccacgccttcagcgactac

SEQ ID NO: 1147 - DNA, 270 bp, Artificial
  Mutation in BnaC.FAD2.b introduced by TALE nuclease pair BnFAD2_T01
caggatccatgggtgcaggtggcagaatgcaagtttctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatagcctcctgcttctactacgtcgccaccacttacttccctctccttcctcaccctctctcctactccacgcctgcagcgactac

SEQ ID NO: 1148 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctacggggcctgccaaggctgcgtcctaacgggcctctgggtcatagcccacgagtgcggccaccacgccttcagcgactac

SEQ ID NO: 1149 - DNA, 360 bp, Artificial
  Mutation in BnaC.FAD2.b introduced by TALE nuclease pair BnFAD2_T01
caggatccatgggtgcaggtggaagaatgcaagtgtctcctcactccagctcccccgaaacgaaaaccctcaaacgcgtcccctgcgagacaccacccttcactctcggagacctcaagaaagcaatcccaactcactgcttcaaacgctccatccctcgctccttctcctacctcctcttcgacatcatcatctcctcctcgtctcctcctccctctaccacctctccacagcctacttccctctcctccccccccctctcccttcccgtggcccctctactgggcctgccaaggctgcgtcctaacgggcctctgggtcatcgcccacgaatgcggccaccacgccctcagcgactac

SEQ ID NO: 1150 - DNA, 348 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctccatccctcgctctttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 1151 - DNA, 332 bp, Artificial
  Mutation in BnaC.FAD2.b introduced by TALE nuclease pair BnFAD2_T01
caggatccatgggtgcaggtggcagaatgcaagtctctcctccctccagctcccccgaaaccaaaaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctgggcctgccaagggtgcgtcctaaccggcgtctgggtcatagcccacgagtgcggccaccacgccttcagcgactac

SEQ ID NO: 1152 - DNA, 349 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttcccttggcccctctactgggcctgccaagggtgcgtcctaacgggcctctgggtcatagcccacgagtgcggccaccacgccttcagcgactac

SEQ ID NO: 1153 - DNA, 316 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatcccacgctccttctcctcttcgacatcatcatctcctcctcgtctcctcctccctctaccacctctccacagcctacttccctctgggtctgccaaggctgcgtcctaacgggcctctgggtcatcgcccacgaatgcggccaccacgccttcagcgactac

SEQ ID NO: 1154 - DNA, 365 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcatcttcgacatcatcatctcctcctccctctaccacctctccacagcctacttccctctcctcccccaccctctcccttacctctccagcggctgttgccgccatcgtgcccctctactgggcctgccaaggctgcgtcctaacgggcctctgggtcatcgcccacgaatgcgcccaccacgccttcagcgactac

SEQ ID NO: 1155 - DNA, 327 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccccctctactgggcctgccaaggctgcgtcctaacgggcctctgggtcatcgcccacgaatgcggccaccacgccttcagcgactac

SEQ ID NO: 1156 - DNA, 354 bp, Artificial
  Mutation in BnaC.FAD2.b introduced by TALE nuclease pair BnFAD2_T01
caggatccatgggtgcaggtggaagaatgcaagtctctcctccctcccgctcccccgaaaccaaaaccctcaaacgcgtcccctgcgagacaccgcccttcactgtcggagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttccctccgcctggcccctctactgggcctgccaaggctgcgtcctaacgggcctctgggtcatcgcccacgaatgctgccaccacgccttcagcgactac

SEQ ID NO: 1157 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 1158 - DNA, 261 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttccctctcccttaccacgccttcagcgactac

SEQ ID NO: 1159 - DNA, 346 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaacatcaaacgcgtcccctgcgagacaccacccttcactctcggagacctcaagaaagcaatcccaccgcactgcttcaaacgctccatccctcgctccttctcctacctcctcttcgacatcctcgtctcctcctccctctaccacctctccacagcctacttccctctcctcccccaccctctcccttatggcccctctactgggcctgccaaggctgcgtcctaacgggcctctgggtcatcgcccacgaatgcggccaccacgccttcagcgactac

SEQ ID NO: 1160 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctaaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctgcccctctactgggcctgccaagggtgcgtcctaacgggcctctgggtcatagcccacgagttcggccaccacgccttcagcgactac

SEQ ID NO: 1161 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacccccctggcccctctactgggcctgccaaggctgcgtcctaacgggcctctgggtcatcgcccacgaatgcggccaccacgccttcagcgactac

SEQ ID NO: 1162 - DNA, 423 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccccccccctctccctacacagcccagcttggagcgaacgacctacaccgaactgagatacctacagcgtgagctatgagaaagcgccacgctatggcccctctactgggcctgccaaggctgcgtcctaaccggcgtctgggtcatagcccacgagtgcggccaccacgccttcagcgactac

SEQ ID NO: 1163 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctactttggcctctctaccgggcctgccaagggtgcgtcctaaccggcgtctgggtcatagcccacgagtgcggccaccacgccttcagcgactac

SEQ ID NO: 1164 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgctggcccctctactgggcctgccaaggctgcgtcctaacgggcctctgggtcatcgcccacgaatgcggccaccacgccttcagcgactac

SEQ ID NO: 1165 - DNA, 327 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccccactgcttcaaacgctccatcccacgctccttctcctcttcgacatcatcatctcctcctcggctcctccctctaccacctctccacagcctacttccctctcctccccctctactgggcctgccaaggctgcgtcctaacgggcgtctgggtcatagcccacgagtgcggccaccacgccttcagcgactac

SEQ ID NO: 1166 - DNA, 338 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatcccacgctccttctcctcttcgacatcatcatctcctcctcggctcctccctctaccacctctccacagcctacttccctctcccttacctcgcctgcccctctactgggcctgccaaggctgcgtcctaacgggcctctgggtcatagcccacgagtgcggccaccacgccttcagcgactac

SEQ ID NO: 1167 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttaccctctactgggcctgccaaggctgcgtcctaacgggcctctgggtcatcgcccacgaatgcggccaccacgccttcagcgactac

SEQ ID NO: 1168 - DNA, 332 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccacctcactgcttcaaacgctccatcccacgctccttctcctcttcgacatcatcatctcctcctcggctcctccctctaccacctctccacagcctacttccctctcctccctggcccctctactgggcctgccaaggctgcgtcctaacgggcctctgggtcatcgcccacgagtgcggccaccacgccttcagcgactac

SEQ ID NO: 1169 - DNA, 346 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctccccacaccctcccccttggcccctctactgggcctgccaaggctgcctcctaacgggcctctgggtcatcgcccacgaatgcggccaccccgccttcagcgacttcc

SEQ ID NO: 1170 - DNA, 448 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatcccacgctccttctcctcttcgacatcctcgtctcctcctccctctaccacctctccacagcctacttccctctcctcccccaccctctcccttaccacgactgctgacgacggccgccaccggctccggggggaagcggggggcctggcacagcaccggggcggcgtgaccgcagtggaggcagtgcatgcatggcgctcgcctggcccctctactgggcctgccaaggctgcgtcctaacgggcctctgggtcatcgcccacgaatgcggccaccacgccttcagcgactac

SEQ ID NO: 1171 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctctactgggcctgccaaggctgcgtcctaacgggcctctgggtcatcgcccacgaatgcggccaccacgccttcagcgactac

SEQ ID NO: 1172 - DNA, 350 bp, Artificial
  Mutation in BnaC.FAD2.b introduced by TALE nuclease pair BnFAD2_T01
caggatccatgggtgcaggtggaagaatgcaagtgtctactccctccaaaaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctccccccccctctcccatgcctctggcccctctactgggcctgccaaggctgcggcctaacgggcctcggggtcatcgcccacgaatgcggccaccacgccttcagcgactac

SEQ ID NO: 1173 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttatggcccctctactgggcctgccaaggctgcgtcctaacgggcctctgggtcatcgcccacgaatgctgccaccacgccttcagcgactac

SEQ ID NO: 1174 - DNA, 261 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacttcactgcttcaaacgctccatcccacgctccttctcctcttcgacatcatcatctcctcctcggctcctccctctaccacctctccacagcctacttccctctcccttaccacgccttcagcgactac

SEQ ID NO: 1175 - DNA, 352 bp, Artificial
  Mutation in BnaC.FAD2.b introduced by TALE nuclease pair BnFAD2_T01
caggatccatgggtgcaggtggaagaatgcaagtctctcctccctccagctccccaggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctccctggcccctctactgggcctgccaaggctgcgtcctaacgggcctctgggtcatcgcccacgaatgcggccaccacgccttcagcgactac

SEQ ID NO: 1176 - DNA, 350 bp, Artificial
  Mutation in BnaC.FAD2.b introduced by TALE nuclease pair BnFAD2_T01
caggatccatgggtgcaggtggaagaatgcaagtctctactccctccagctcccccgaaaccaaaaccctcaaacgcgtcccctgcgagacaccacccttcactctcagacacctcaagaaagcagtcccaccgcactgtttcaaacgctcgatccctcgctctttctcctacctcatctgggacatcatcatagcctcctgcttctactacttcgccaccccttacttccctctcctccctcaccctctcccttgcctctagcccctctacggggcccgccagggccgcgtcttgacgggcctcggggtcatagcccacgagtgcggccaccacgccttcagcgactac

SEQ ID NO: 1177 - DNA, 312 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcctcatctcctcccccgccccttcctcaccctctctcccgcctggcctctctactgggcctgccagggctgcgtcctaacgggcctctgggtcatagcccacgagtgcggccaccacgccttcagcgactac

SEQ ID NO: 1178 - DNA, 356 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttccctcgcgcctggcccctctactgggcctgccaaggctgcgtcctaacgggcctctgggtcatagcccacgagtgcggccaccacgccttcagcgactac

SEQ ID NO: 1179 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttcccctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 1180 - DNA, 340 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgcttcaaacgctccatccctcgctccttctcctacctcctcttcgacatcctcgtctcctcctccctctaccacctctccacagcctacttccctctcctcccccaccctccccctccctctactgggcctgccaaggctgcgtcctaacgggcctctgggtcatagcccacgagtgcggccaccacgccttcagcgactac

SEQ ID NO: 1181 - DNA, 402 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttaccttgcctcgggcatccaagcagcaagcgcgttacgccgtgggtcgatgtttgactggcccctctactgggcctgccaaggctgcgtcctaacgggcctctgggtcatcgcccacgaatgcggccaccacgccttcagcgactac

SEQ ID NO: 1182 - DNA, 350 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 1183 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctcgcctggcccctctactgggcctgccaaggctgcgtcctaacgggcctctgggtcatcgcccacgaatgcggccaccacgccttcagcgactac

SEQ ID NO: 1184 - DNA, 336 bp, Artificial
  Mutation in BnaC.FAD2.b introduced by TALE nuclease pair BnFAD2_T01
caggatccatgggtgcaggtggaagaatgcaagtctctcctccctcccgctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctgggcctgccaaggctgcgtcctaacgggcctctgggtcatcgcccacgaatgcggccaccacgccttcagcgactac

SEQ ID NO: 1185 - DNA, 381 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctctcctcgctcgccccagccgatcgcccgtgcgccgcgtggcccctctactgggcctgccaaggctgcgtcctaacgggcctctgggtcatcgcccacgagtgcggccaccacgccttcagcgactac

SEQ ID NO: 1186 - DNA, 349 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttcccttggcccctctactgggcctgccaaggctgcgtcctaaccggcgtctgggtcatagcccacgagtgcggccaccacgccttcagcgactac

SEQ ID NO: 1187 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctctctactgggcctgccaagggtgcgtcctaaccggcgtctgggtcatagcccacgagtgcggccaccacgccttcagcgactac

SEQ ID NO: 1188 - DNA, 340 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctccctctactgggcctgccaagggtgcgtcctaaccggcgtctgggtcatagcccacgagtgcggccaccacgccttcagcgactac

SEQ ID NO: 1189 - DNA, 345 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctactttcctctcctcccccaccctctcccctaggcctctctactgggcctgccaagggtgcgtcctaaccggcgtctgggtcatagcccacgagtgcggccaccacgccttcagcgactac

SEQ ID NO: 1190 - DNA, 359 bp, Artificial
  Mutation in BnaC.FAD2.b introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctcgtctggcccctctactgggcctgccaaggctgcgtcctaacgggcctctgggtcatcgcccacgaatgcggccaccacgccttcagcgactac

SEQ ID NO: 1191 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttatggcccctctactgggcctgccaaggctgcgtcctaacgggcctctgggtcatcgcccacgaatgcggccaccacgccttcagcgactac

SEQ ID NO: 1192 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctgcccctctactgggcctgccaaggctgcgtcctaacgggcctctgggtcatcgcccacgaatgcggccaccacgccttcagcgactac

SEQ ID NO: 1193 - DNA, 355 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcctgcctggcccctctactgggcctgccaaggctgcgtcctaacgggcctctgggtcatagcccacgagtgcggccaccacgccttcagcgactac

SEQ ID NO: 1194 - DNA, 311 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctcaccctctctcctactggcctctctactgggcctgccagggctgcgtcctaaccggcgtctgggtcatagcccacgagtgcggccaccacgccttcagcgactac

SEQ ID NO: 1195 - DNA, 340 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggggacctcaagaaagcaatcccacctcactgcttcaaacgctccatccctcgctccttctcctacctcctcttcgacatcctcgtctcctcctccctctaccacctctccacagcctacttccctctcctcccccacccgcctggcccctctactgggcctgccaaggctgcgtcctaacgggcctctgggtcatcgcccacgaatgcggccaccacgccttcagcgactac

SEQ ID NO: 1196 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctactttggcctctctactgggcctgccagggctgcgtcctaaccggcgtctgggtcatagcccacgagtgcggccaccacgccttcagcgactac

SEQ ID NO: 1197 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccactggcccctctactgggcctgccaaggctgcgtcctaacgggcctctgggtcatagcccacgagtgcggccaccacgccttcagcgactac

SEQ ID NO: 1198 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccgccctctcccttaccgtggcccctctactgggcctgccaaggctgcgtcctaacgggcctctgggtcatcgcccacgaatgcggccaccacgcctgcagcgactac

SEQ ID NO: 1199 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcggcctaacgggcctctgggtcatcgcccacgaatgcggccaccacgccttcagcgactac

SEQ ID NO: 1200 - DNA, 295 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacaccctcgtctcctcctcccccgccctctctcctgggcctgccaaggctgcgtcctaacgggcctctgggtcatcgcccacgaatgcggccaccacgccttcagcgactac

SEQ ID NO: 1201 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagccacgatggcggcaagcaggcgctggagcctggcccctctactgggcctgccaaggctgcgtcctaacgggcctctgggtcatagcccacgagtgcggccaccacgccttcagcgactac

SEQ ID NO: 1202 - DNA, 313 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctcaccctctctcctacgctggcctctctactgggcctgccagggctgcgtcctaaccggcgtctgggtcatagcccacgagtgcggccaccacgccttcagcgactac

SEQ ID NO: 1203 - DNA, 348 bp, Artificial
  Mutation in BnaC.FAD2.b introduced by TALE nuclease pair BnFAD2_T01
caggatccatgggtgcaggtggaagaatgcaagtttctcctccctccagctccaccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctccagcgtagcctctcaactgggcctgccaagggtgcgtcctaacgggcctctgggtcatcgcccacgaatgcggccgccacgccttcagcgactac

SEQ ID NO: 1204 - DNA, 455 bp, Artificial
  Mutation in BnaC.FAD2.b introduced by TALE nuclease pair BnFAD2_T01
caggatccatgggtgcaggtggaagaatgcaagtctatcctccctccagctcccccggaaccaacaccctcaaacgcgtctcctgcgagacaccaccattcactctcggagacctcaagaaagcaatcccacctcactgcttcaaacgctccatccctcgctccttctcctacctcctcttcgacatcctcgtctcctcctccctctaccacctctccacggcctacttccctctcctcccccaccctctccctgcccccgccggctgccgagggccaccgccggctccggggtcaagccgtgggcctggcacagcaccggggcggcgtgaccgcagtggaggcagtgcatgcatggcgctcgcctggcccctctactgggcctgccaaggctgcgtcctaacgggcctctgggtcatcgagcacgagtgcggccaccacgcctgcagcgactac

SEQ ID NO: 1205 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctcactctgtctcgctactgggcctgccaagggcgcgtcctaaccggcgtcggggtcatagcccacgagtgcggccaccacgccttcagcgactac

SEQ ID NO: 1206 - DNA, 346 bp, Artificial
  Mutation in BnaC.FAD2.b introduced by TALE nuclease pair BnFAD2_T01
caggatccatgggtgcaggtggaagaatgcaagtgtctcccccctccaagaagcctgaaaccgacaccatcaaccgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccgtatggcccctctactgggcctgccagggctgcgtcctatcgggcctctgggtcatcgcccacgaatgcggccaccacgccttcagcgactac

SEQ ID NO: 1207 - DNA, 354 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccctggcccctctactgggcctgccagggctgcgtcctaaccggcgtctgggtcatagcccacgagtgcggccaccacgccttcagcgactac

SEQ ID NO: 1208 - DNA, 311 bp, Artificial
  Mutation in BnaC.FAD2.b introduced by TALE nuclease pair BnFAD2_T01
caggatccatgggtgcaggtggaagaatgcaagtctatactccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctcaccctctctcctattggcctctctactgggcctgccaagggtgcgtcctaaccggcgtctgggtcatagcccacgagtgcggccaccacgccttcagcgactac

SEQ ID NO: 1209 - DNA, 433 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttaaagtcgcctaaggtcactatcagctagcaaatatttcttgtcaaattgatgagcaatgcttttttataatgccaactttcgcctggcctctctactgggcctgccaagggtgcgtcctaaccggcgtctgggtcatagcccacgagtgcggccaccacgccttcagcgactac

SEQ ID NO: 1210 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgccggcctctctactgggcctgccaagggtgcgtcctaaccggcgtctgggtcatagcccacgagtgcggccaccacgccttcagcgactac

SEQ ID NO: 1211 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccgtacctctaccgggcctgccaaggctgcgtcctaacgggcctctgggtcatcgcccacgaatgcggccaccacgccttcagcgactac

SEQ ID NO: 1212 - DNA, 340 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattgactctcggagacctcaagaaagcaatcccacctcactgcttcaaacgctccatcccacgctccttctcctcttcgacatcctcgtctcctcctccctctaccacctctccacagcctacttccctctcctcccccaccctctctcctactcgcctctctactgggcctgccatggctgcgtcctaaccggcgtctgggtcatagcccacgagtgcggccaccacgccttcagcgactac

SEQ ID NO: 1213 - DNA, 350 bp, Artificial
  Mutation in BnaC.FAD2.b introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctcccacctctccacagcctacttccctctcctccccctccctctcccttacctctggcccctctactgggcctgccaaggctgcgtcctaacgggcctctgggtcatagcccacgagtgcggccaccacgccttcagcgactac

SEQ ID NO: 1214 - DNA, 314 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttccacatcatcatctcctcctcggctcctccctcaccctctctcctacttctggcctctctactgggcctgccagggctgcgtcctaaccggcgtctgggtcatagcccacgagtgcggccaccacgccttcagcgactac

SEQ ID NO: 1215 - DNA, 327 bp, Artificial
  Mutation in BnaC.FAD2.b introduced by TALE nuclease pair BnFAD2_T01
caggatccatgggtgcaggtggcagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccccctctactgggcctgccaaggctgcggcctaacgggcctctgggtcatcgcccacgaatgcggccaccacgccttgagcgactac

SEQ ID NO: 1216 - DNA, 401 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcctcgggcatccaagcagcaagcgcgttacgccgtgggtcgatgtttgactggcccctctactgggcctgccaaggctgcgtcctaacgggcctctgggtcatcgcccacgaatgcggccaccacgccttcagcgactac

SEQ ID NO: 1217 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcgtctgggtcatagcccacgagtgcggccaccacgccttcagcgactac

SEQ ID NO: 1218 - DNA, 338 bp, Artificial
  Mutation in BnaC.FAD2.b introduced by TALE nuclease pair BnFAD2_T01
caggatccattggtgcaggtggaagaatgcaagtctctcctccctccagctcccccggaaccaacaccatcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttacctcgccgaccccgctactgggcctgccaaggctgcgtcctaacgggcctctgggtcatagcccacgagtgcggccaccacgccttcagcgactac

SEQ ID NO: 1219 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcccctctactgggcctgccatggctgcgtcctaacgggcctctgggtcatcgcccacgaatgcggccaccacgccttcagcgactac

SEQ ID NO: 1220 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaacaccctcaaacgcgtcccctgcgagacaccgcccttcactctcggagacctcaagaaagcaatcccacctcactgcttcaaacgctccatccctcgctccttctcctacctcatcttcgacatcctcatcgcctcctccctctaccacctctccaccacctacttccctctcctcccccaccctctcccgcccctggcccctctacggggcctgccaaggctgcgccctaacgggcctcggggtcatcgcccacgaatgcggacaccacgcatgcagcgactac

SEQ ID NO: 1221 - DNA, 401 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttaccttgcctcgggcatccaagcagcaagcgcgttacgccgtgggtcgatgtttgactggcccctctactgggcctgccaaggctgcgtcctaacgggcctctgggtcatcgcccacgaatgcggccaccacgccttcagcgactac

SEQ ID NO: 1222 - DNA, 341 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatccctcgctccttctcctacctcctcttcgacatcctcgtctcctcctccatctaccacctctccacagcctacttccctctcctcccccaccctctctggcccctctactgggcctgccaaggctgcgtcctaacgggcctctgggtcatcgcccacgaatgcggccaccacgccttcagcgactac

SEQ ID NO: 1223 - DNA, 338 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttacctcgcctggccctctactgggcctgccaaggctgcgtcctaacgggcctctgggtcatcgcccacgaatgcggccaccacgccttcagcgactac

SEQ ID NO: 1224 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttatggcccctctactgggcctgccaagcctgcgtcctaacgggcctctgggtcatcgcccacgaatgcggccaccacgccttcagcgactac

SEQ ID NO: 1225 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctaaccagggcccctctactgggcctgccaaggctgcgacctaacgggccgcagggtcagagcccacgagtgcggccaccacgccttcagcgactac

SEQ ID NO: 1226 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 1227 - DNA, 348 bp, Artificial
  Mutation in BnaC.FAD2.b introduced by TALE nuclease pair BnFAD2_T01
caggatccatgggtgcaggtggaagaatgcaagtgtctcctcactccaagaagtctgaaaccgacaccatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcctcccccaccctctctcccacgctggcctctctactgggcctgccagggctgcgtccgaacgggcctgtgggtcatcgcccacgaatgcgtccacgactcctgcagcgctac

SEQ ID NO: 1228 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttggcctctctactgggcctgccaagggtgcgtcctaacgggcctctgggtcatagcccacgagtgcggccaccacgccttcagcgactac

SEQ ID NO: 1229 - DNA, 341 bp, Artificial
  Mutation in BnaC.FAD2.b introduced by TALE nuclease pair BnFAD2_T01
caggatccatgggtgcaggtggaagaatgcaagtctctactccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccaccgcctacttccctctcctcccccaccctctccctaacctctactgggcctgccaaggctgcggcctaacgggcctctgggtcatcgcccacgaatgcggccaccacgccttcagcgactac

SEQ ID NO: 1230 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttaccccctctactgggcctgccaaggctgcgtcctaacgtgcctctgggtcatcgcccacgaatgcggccaccacgccttcagcgactac

SEQ ID NO: 1231 - DNA, 381 bp, Artificial
  Mutation in BnaC.FAD2.b introduced by TALE nuclease pair BnFAD2_T01
caggatccatgggtgcaggtggaagaatgcaagtctatactccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgctcgcctcagccgaacgaccgagcgcagcgtggcccctagacggggcctccgaagcctccgacgtgtcgaggcgccgggccatcgcgcaagtatttggcgaccgcgccaagagcaactac

SEQ ID NO: 1232 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctccctttcctctggcccctctactgggcctgccaaggctgcgtcctaacgggcctctgggtcatcgcccacgaatgcggccaccacgccttcagcgactac

SEQ ID NO: 1233 - DNA, 381 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgctcgccgcagccgaacgaccgagcgcagcgtggcccctctactgggcctgccaaggctgcgtcctaacgggcctctgggtcatcgcccacgaatgtggccaccacgccttcagcgactac

SEQ ID NO: 1234 - DNA, 342 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctcttcgacatcatcatctcctcctccctctaccacctctccacagcctacttccctctcctcccccaccctctcccttaccttggcccctctactgggcctgccaaggctgcgtcctaacgggcctctgggtcatcgcccacgaatgcggccaccacgcctgcagcgactac

SEQ ID NO: 1235 - DNA, 349 bp, Artificial
  Mutation in BnaC.FAD2.b introduced by TALE nuclease pair BnFAD2_T01
caggatccatgggtgcaggtggaagaatgcaagtctctcctccctccagctccaccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactggtcctgccaaggctgcgtcctaacgggcctctgggtcatcgcccacgaatgcggccaccacgccttcagcgactac

SEQ ID NO: 1236 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctcccccctctccacagcctacttccctctcctccctcaccctctctcctactttggcctctctactgggcctgccagggctgcgtcctaaccggcgtctgggtcatagcccacgagtgcggccaccacgccttcagcgactac

SEQ ID NO: 1237 - DNA, 345 bp, Artificial
  Mutation in BnaC.FAD2.b introduced by TALE nuclease pair BnFAD2_T01
caggatccatgggtgcaggtggaagaatgcaagtctctactccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctccctctacggggcctgccaaggctgcgtcctaacgggcctctgggtcatcgcccacgaatgcggccaccacgccttcagcgactac

SEQ ID NO: 1238 - DNA, 348 bp, Artificial
  Mutation in BnaC.FAD2.b introduced by TALE nuclease pair BnFAD2_T01
caggatccatgggtgcaggtggaagaatgcaagtctctactccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctcacctggcccctctactgggcctgccaaggctgcgtcctgacgggcctctgggtcatcgcccacgaatgcggccaccacgccttcagcgactac

SEQ ID NO: 1239 - DNA, 337 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcacgcgcgtaccctgcgagacaccgcccttcactgtcggagaactcaagaaagcaatcccacctcactgcttcaaacgctccatcccacgctccttctcctacctcctcttcgacatcctcgtctcctcctccctctaccacctctccacagcctacttccctctcctccccccccctctcccctctactgggcctgccaaggctgcgtcctaacgggcctctgggtcatcgcccacgaatgcggccaccacgccttcagcgactac

SEQ ID NO: 1240 - DNA, 351 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatcccacgctccttctcctcttcgacatcatcatctcctcctcggctcctccctctaccacctctccacagcctacttccctctcctcccccaccctctcccttccctctggcccctctactgggcctgccaaggctgcgtcctaacgggcctctgggtcatcgcccacgaatgcggccaccacgccttcagcgactac

SEQ ID NO: 1241 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctccccccccctctcccttacctctggcccctctactgggcctgccaaggctgcgtcctaacgggcctctgggtcatagcccacgagtgcggccaccacgccttcagcgactac

SEQ ID NO: 1242 - DNA, 349 bp, Artificial
  Mutation in BnaC.FAD2.b introduced by TALE nuclease pair BnFAD2_T01
caggatccatgggtgcaggtggaagaatgcaagtctctactccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctgcccccggcccctctacggggcctgccaaggctgcgtcctaacgggcctctgggtcatcgcccacgaatgcggccaccacgcctgcagcgactac

SEQ ID NO: 1243 - DNA, 358 bp, Artificial
  Mutation in BnaC.FAD2.b introduced by TALE nuclease pair BnFAD2_T01
caggatccatgggtgcaggtggaagaatgcaagtctctacccgctccagctcccccgaaaccaaaaccctcaaccgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctcgcctggcccctctactgggcctgccaaggctgcgtcctaacgggcctctgggtcatagcccacgagtgcggccaccacgccttcagcgactac

SEQ ID NO: 1244 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctccaccctctaccacctctccacagcctacttccctctcctccctcaccctccctcctacttctggcctctctactgggcctgccaagggtgcgtcctaaccggcgtctgggtcatagcccacgagtgcggccaccacgcctgcagcgactac

SEQ ID NO: 1245 - DNA, 350 bp, Artificial
  Mutation in BnaC.FAD2.b introduced by TALE nuclease pair BnFAD2_T01
caggatccatgggtgcaggtggaagaatgcaagtctctcccccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 1246 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaacgctccatccctcgctccttcccctacctcctcttcgacatcctcgtctcctcctccctctaccacctctccacggcctacttccctctcctccccctccccctcccttgcctctggcccctctactgggcctgccaaggctgcggcctaacgggcctctgggtcatcgcccacgaatgcggccaccacgccttcagcgactac

SEQ ID NO: 1247 - DNA, 349 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatagcccacgagtgcggccaccacgccttcagcgactac

SEQ ID NO: 1248 - DNA, 261 bp, Artificial
  Mutation in BnaC.FAD2.b introduced by TALE nuclease pair BnFAD2_T01
caggatccatgtgtgcaggtggaagaatgcaagtctctcctccctccagctcccccgaaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttaccacgccttcagcgactac

SEQ ID NO: 1249 - DNA, 346 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctctactgggcctgccaaggctgcgtcctaacgggcctctgggtcatcgcccacgagtgcggccaccacgccttcagcgactac

SEQ ID NO: 1250 - DNA, 336 bp, Artificial
  Mutation in BnaC.FAD2.b introduced by TALE nuclease pair BnFAD2_T01
caggatccatgggagcaggtggaagaatgcaagtctctcccccctccagctcccccggaaccaaaaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctactgggcctgccagggctgcgtcctaaccggcgtctgggtcatagcccacgagtgcggccaccacgccttcagcgactac

SEQ ID NO: 1251 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctccccccccctctcccttacctctggcccctctactgggcctgccaaggctgcgtcctaacgggcctctgggtcatcgcccacgaatgcggccaccacgccttcagcgactac

SEQ ID NO: 1252 - DNA, 374 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccccccccccctcccttccccctccagcgcctgcttgccgccatcgtgcccctctactgggcctgccaaggctgcgtcctaacgggcctctgggtcatagcccacgagtgcggccaccacgccttcagcgactac

SEQ ID NO: 1253 - DNA, 312 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctcaccctctctcctacttggcctctctactgggcctgccaaggctgcgtcctaacgggcctctgggtcatagcccacgagtgcggccaccacgccttcagcgactac

SEQ ID NO: 1254 - DNA, 326 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgccatcctcctctcctcctccccctaccacctctccacagcctacttccctctcctccccctctactgggcctgccaaggctgcgtcctaacgggcgtctgggtcatagcccacgagtgcggccaccacgccttcagcgactac

SEQ ID NO: 1255 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctcggctcctccctctaccacctctccacagcctacttccctctcccttacctctggcccctctactgggcctgccagggctgcgtcctaaccggcgtctgggtcatagcccacgagtgcggccaccacgccttcagcgactac

SEQ ID NO: 1256 - DNA, 342 bp, Artificial
  Mutation in BnaC.FAD2.b introduced by TALE nuclease pair BnFAD2_T01
caggatccatgggtgcaggtggaagaatgcaagtctatcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctactgggcctgccaaggctgcgtcctaaccggcgtctgtgtcatagcccacgagtgcggccaccacgccttcagcgacctac

SEQ ID NO: 1257 - DNA, 350 bp, Artificial
  Mutation in BnaC.FAD2.b introduced by TALE nuclease pair BnFAD2_T01
caggatccatgggtgcaggtggaagaatgcaagtgtcccctccctccaaaaagcctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 1258 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcatcatctcctcctcggctcctccctctaccacctctccacagcctacttccctctcctcccccaccctctccccctctactgggcctgccaaggctgcgtcctaacgggcctctgggtcatcgcccacgaatgcggccaccacgccttcagcgactac

SEQ ID NO: 1259 - DNA, 350 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaatgctgcgtcctaacgggcctctgggtcatcgcccacgaatgcggccaccacgccttcagcgactac

SEQ ID NO: 1260 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcccctctactgggcctgccaaggctgcgtcctaacgggcctctgggtcatagcccacgagtgcggccaccacgccttcagcgactac

SEQ ID NO: 1261 - DNA, 358 bp, Artificial
  Mutation in BnaC.FAD2.b introduced by TALE nuclease pair BnFAD2_T01
caggatccatgggtgcaggtggaagaatgcaagtgtatcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcctcgtctggcccctctactgggcctgccaaggctgcgtcctaacgggcctctgggtcatcgcccacgaatgcggccaccacgccttcagcgactac

SEQ ID NO: 1262 - DNA, 343 bp, Artificial
  Mutation in BnaC.FAD2.b introduced by TALE nuclease pair BnFAD2_T01
caggatccatgggtgcaggtggaagaatgcaagtctctactccctccagctcccccggaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttcccgcacctcccccaccctcacccttacccctctactgggcctgccaaggctgcgtcctaacgggcctctggggcatcgcccacgaatgcggccaccacgcctgcagcgactac

SEQ ID NO: 1263 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttctggcctctctactgggcctgccagggctgcgtcctaacgggcctctgggtcatagcccacgagtgcggccaccacgccttcagcgactac

SEQ ID NO: 1264 - DNA, 349 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatccctcgctccttctcctacctcctcttcgacatcctcgtctcctcctccctcgaccacctctccacagcctacttccctctcctccccccccctctcccttcccttggcccctctactgggcctgccaaggctgcggcctaacgggcctctgggtcatcgcccacgaatgcggccaccacgccttcagcgactac

SEQ ID NO: 1265 - DNA, 259 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcccttaccacgccttcagcgacta

SEQ ID NO: 1266 - DNA, 342 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccctctactgggcctgccaaggctgcgtcctaacgggcctctgggtcatcgcccacgaatgcggccaccacgccttcagcgactac

SEQ ID NO: 1267 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctgccctctactgggcctgccaaggcttcgtcctaacgggcctctgggtcatagcccacgagtgcggccaccacgccttcagcgactac

SEQ ID NO: 1268 - DNA, 350 bp, Artificial
  Mutation in BnaC.FAD2.b introduced by TALE nuclease pair BnFAD2_T01
caggatccatgggtgcaggtgcaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 1269 - DNA, 318 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctcctacttcgccctggcctctctactgggcctgccaagggtgcgtcctaaccggcgtctgggtcatagcccacgagtgcggccaccacgccttcagcgactac

SEQ ID NO: 1270 - DNA, 345 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctccccccccaccctctcccttccctccctctactgggcctgccaaggctgcgtcctaacgggcctctgggtcatcgcccacgaatgcggccaccacgccttcagcgactac

SEQ ID NO: 1271 - DNA, 348 bp, Artificial
  Mutation in BnaC.FAD2.b introduced by TALE nuclease pair BnFAD2_T01
caggatccatgggtgcaggtggaagaatgcaagtctctactccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctccctgaccaggcccctctactgggcctgccaaggctgcgtcctaacgggcctctgggtcatcgcccacgaatgcggccaccacgccttcagcgactac

SEQ ID NO: 1272 - DNA, 339 bp, Artificial
  Mutation in BnaC.FAD2.b introduced by TALE nuclease pair BnFAD2_T01
caggatccatgggtgcaggtggaagaatgcaagtctctcctccctccaactcccccggaaccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctcccccaccctctcccttacctgccctctactgggcctgccaaggctgcgtcctaacgggcctctgggtcatcgcccacgaatgcggccaccacgccttcagcgactac

SEQ ID NO: 1273 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttaccttggcccctctactgggcctgccaagggtgcgtcctaaccggcgtctgggtcatagcccacgagtgcggccaccacgccttcagcgactac

SEQ ID NO: 1274 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctccctggcccctctactgggcctgccaaggctgcgtcctaacgggcctctgggtcatagcccacgagtgcggccaccacgccttcagcgactac

SEQ ID NO: 1275 - DNA, 335 bp, Artificial
  Mutation in BnaC.FAD2.b introduced by TALE nuclease pair BnFAD2_T01
caggatccatgggtgcaggtggaagaatgcaagtctctcctccctccagctcccccggaaccaaaaccctcaaacgcgtcccctgcgagacaccaccattcactctcggagacctcaagaaagcaatcccacctcactgcttcaaacgctccatcccacgctccttctcctcttcgacatcatcatagcctcctgcttctactacgtcgccaccacttacttccctctcctccctcaccctcgcctggcctctctactgggcctgccaagggtgcgtcctaaccggcgtctgggtcatagcccacgaatgcggccaccacgccttcagcgactac

SEQ ID NO: 1276 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttatcctacctcctcttcgacatcctcgtctcctcctccctctaccacctctccacagcctacttccctctcctcccccaccctctcccttccctgcccctctactgggcctgccaaggctgcgtcctaacgggcctctgggtcatcgcccacgaatgcggccaccacgccttcagcgactac

SEQ ID NO: 1277 - DNA, 356 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcgcctggcctctctactgggcctgccagggctgcgtcctaaccggcgtctgggtcatagcccacgagtgcggccaccacgccttcagcgactac

SEQ ID NO: 1278 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctatccacagcctacttccctctcctccccccccctctcccttacctctggcccctctactgggcctgccaaggctgcgtcctaacgggcctctgggtcatcgcccacgaatgcggccaccacgccttcagcgactac

SEQ ID NO: 1279 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctccttggcctctctactgggcctgccaagggtgcgtcctaacgggcctctgggtcatcgcccacgaatgcggccaccacgccttcagcgactac

SEQ ID NO: 1280 - DNA, 348 bp, Artificial
  Mutation in BnaC.FAD2.b introduced by TALE nuclease pair BnFAD2_T01
caggatccatgggtgcaggtggcagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttggcctctctactgggcctgccagggctgcgtcctaaccggcgtctgggtcatagcccacgagtgcggccaccacgccttcagcgactac

SEQ ID NO: 1281 - DNA, 356 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcgcctggcctctctactgggcctgccagggctgcgtcctaaccggcgtctgggtcatagcccacgagtgcggccaccacgccttcagcgactac

SEQ ID NO: 1282 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctccttcctcctcttcgacatcctcgtctcctcctccctctaccacctctccacagcctacttccctctcctcccccaccctctcccttacctcgccctggcccctctactgggcctgccaaggctgcgtcctaacgggcctctgggtcatcgcccacgaatgcggccaccacgccttcagcgactac

SEQ ID NO: 1283 - DNA, 307 bp, Artificial
  Mutation in BnaC.FAD2.b introduced by TALE nuclease pair BnFAD2_T01
caggatccatgggtgcaggtggaagaatgcaagtctctactccctccagctcccccggaaccaacaccctcaaacgcgtcccctgcgagacaccaccattcactctcggagacctcaagaaagcaatcccacctcactgcttcaaacgctccaacccacgctccttctcctcttcgacatcatcatctcctcctcggctcctccctcaccctctctcctacctctctactgggcctgccagggctgcgtcctaaccggcgtctgtgtcatagcccacgagtgtggccaccacgccttcagcgactac

SEQ ID NO: 1284 - DNA, 356 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccacctggcccctctactgggcctgccaaggctgcgtcctaacgggcctctgggtcatagcccacgagtgcggccaccacgccttcagcgactac

SEQ ID NO: 1285 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctccccccccaccctctcccttccctcccctctactgggcctgccaaggctgcgtcctaacgggcctctgggtcatcgcccacgaatgcggccaccacgccttcagcgactac

SEQ ID NO: 1286 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccaacgctccttctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 1287 - DNA, 394 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttcccccgggagcggatttgaacgttgtgaagcaccggcccggaggggggcgggcgtctctactgggcctgccaaggctgcggcctaacgggcctctgggtcatcgcccacgaatgcggccaccacgccttcagcgactac

SEQ ID NO: 1288 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctcccccttacccctctactgggcctgccaaggctgcgtcctagcgggcctctgggtcatcgcccacgaatgcggccaccacgccttcagcgactac

SEQ ID NO: 1289 - DNA, 350 bp, Artificial
  Mutation in BnaC.FAD2.b introduced by TALE nuclease pair BnFAD2_T01
caggatccatgggtgcaggtggaagaatgcaagtgtctcctacctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctttcctctggcccctctactgggcctgccaaggctgcgtcctaacgggcctctgggtcatcgcccacgaatgcggccaccacgccttcagcgactac

SEQ ID NO: 1290 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctggcccctctactgggccggccaaggctgcgtcctaacgggcctcggggtcatagcccacgagtgcggcctccacgccttcatcgactac

SEQ ID NO: 1291 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccccctaccacctctccacagcctacttccctcccctcccccaccctctcccgtacctttgcccctctactgggcctgccaaggctgcgtccaaacgggcctctgggtcatcgcccacgaatgcggccaccacgccctcatcgactac

SEQ ID NO: 1292 - DNA, 260 bp, Artificial
  Mutation in BnaC.FAD2.b introduced by TALE nuclease pair BnFAD2_T01
caggatcatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttaccacgccttcagcgactac

SEQ ID NO: 1293 - DNA, 391 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctcccctacttgctggcgatggccaccccctgctggggggtcaagccgtgggcggcctctctactgggcctgccaagggtgcgtcctaacgggcctctgggtcatagcccacgagtgcggccaccacgccttcagcgactac

SEQ ID NO: 1294 - DNA, 336 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttacctctggcccctctactgggcctgccaaggctgcgtcctaacgggcctctgggtcatcgcccacgaatgcggccaccacgccttcagcgactac

SEQ ID NO: 1295 - DNA, 309 bp, Artificial
  Mutation in BnaC.FAD2.b introduced by TALE nuclease pair BnFAD2_T01
caggatccatgggtgcaggtggaagaatgcaagtctctccttcctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctcaccctctctcctactcctctctactgggcctgccagggctgcgtcctaacgggcctcttgttcatagcgcacgagtgcggctaccacgccttcatcgactac

SEQ ID NO: 1296 - DNA, 336 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccccctcccttacctgggcctgccaaggctgcgtcctaacgggcctctgggtcatcgcccacgaatgcggccaccacgccttcagcgactac

SEQ ID NO: 1297 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcatcgactac

SEQ ID NO: 1298 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttgcctctctactgggcctgccaagggtgcgtcctaaccggcgtctgggtcatagcccacgagtgcggccaccacgccttcagcgactac

SEQ ID NO: 1299 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcgtctcctcctccctctaccacctctccacagcctacttccctctcctcccccaccctctcccttatggcccctctactgggcctgccaaggctgcgtcctaacgggcctctgggtcatcgcccacgaatgcggccaccacgccttcagcgactac

SEQ ID NO: 1300 - DNA, 421 bp, Artificial
  Mutation in BnaC.FAD2.b introduced by TALE nuclease pair BnFAD2_T01
caggatccatgggtgcaggtggcagaatgcaagtgtctcctccatccaagaagtctgaaaccgacaccatcaagcgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccccaccctctccctacacagcccagcttggagcgaacgacctacaccgaactgagatacctacagcgtgagctatgagaaagcgccacgctatggcccctctactgggcctgccaaggctgcgtcctaacgggcctctgggtcatagcccacgagtgcggccaccacgccttcagcgactac

SEQ ID NO: 1301 - DNA, 349 bp, Artificial
  Mutation in BnaC.FAD2.b introduced by TALE nuclease pair BnFAD2_T01
caggatccatgggtgcaggtggaagaatgcaagtgtcacctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactcggcctgccaaggctgcgtcctaacgggcctctgggtcatcgcccacgaatgcggccaccacgccttcagcgactac

SEQ ID NO: 1302 - DNA, 429 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttccctccccagcggctgttgccggtgctgtgccaggcccccggcttgaccccggagcaggtggtggccatcgccagccacgatggtagcccctctactgggcctgccaaggctgcgtccgaacgggcctctgggtcatcgcccacgaatgcggccaccacgccttcagcgactac

SEQ ID NO: 1303 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttggcccctctactgggcctgccagggctgcgtcctaaccggcgtctgggtcatagcccacgagtgcggccaccacgccttcagcgactac

SEQ ID NO: 1304 - DNA, 422 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgttgccggtgctgtgccaggcccacggcttgaccccggagcaggtggtggccatcgccagcaatattggtgctggcccctctactgggcctgccaagggtgcgtcctaaccggcgtctgggtcatagcccacgagtgcggccaccacgccttcagcgactac

SEQ ID NO: 1305 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctccaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctactccgctggcctctctactgggcctgccaagggtgcgtcctaaccggcgtctgggtcatagcccacgagtgcggccaccacgccttcagcgactac

SEQ ID NO: 1306 - DNA, 355 bp, Artificial
  Mutation in BnaC.FAD2.b introduced by TALE nuclease pair BnFAD2_T01
caggatccatgggtgcaggtggaagaatgcaagtctctcccccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcgcctggcccctctactgggcctgccagggctgcgtcctaaccggcgtctgggtcatagcccacgagtgcggccaccacgcctgcagcgactac

SEQ ID NO: 1307 - DNA, 356 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccgcgccgcctggcccctctactgggcctgccaaggctgcgtcctaacgggcctcggggtcatcgcccacgaatgcggccaccgcgccttcagcgactac

SEQ ID NO: 1308 - DNA, 401 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccccctcccttaccttgcctcgggcatccaagcagcaagcgcgttacgccgtgggtcgatgtttgactggcccctctactgggcctgccaaggctgcgtcctaacgggcctctgggtcatcgcccacgaatgcggccaccacgccttcagcgactac

SEQ ID NO: 1309 - DNA, 338 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctccgccgcccctccctctacaacctctccacagcctacttccctctcccttacctcgcctgcccctctactgggcctgccaaggctgcgtcctaacgggcctctgggtcatagcccacgagtgcggccaccacgccttcagcgactac

SEQ ID NO: 1310 - DNA, 412 bp, Artificial
  Mutation in BnaC.FAD2.b introduced by TALE nuclease pair BnFAD2_T01
caggatccatgggtgcaggtggaagaatgcaagtctctcatccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgctggagacggtccagcggctgttgccggtgctgtgccaggcccacggcttgaccccggagctggcccctctactgggcctgccaaggctgcgtcctaacgggcctctgggtcatcgcccacgaatgcggccaccacgccttcagcgactac

SEQ ID NO: 1311 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgcttcaaacgctccatccctcgctccttctcctacctcctcttcgacatcctcgtctcctcctccctctaccacctctccacagcctacttccctctcctcccccaccccctcccttacccctggcccctctactgggcctgccaaggctgcgtcctaacgggcctctgggtcatcgcccacgaatgcggccaccacgccttcagcgactac

SEQ ID NO: 1312 - DNA, 357 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctccccttcgacatcatcatctcctcctcggctcctccctctaccacctctccacagcctacttccctctcctcccccaccctctcccttacctcgccacctggcccctctactgggcctgccaaggctgcgtcctaacgggcctctgggtcatcgcccacgaatgcggccaccacgccttcagcgactac

SEQ ID NO: 1313 - DNA, 351 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctccccccccaccctctcccttacctctggcccctctactgggcctgccaaggctgcgtcctaacgggcctctgggtcatagcccacgagtgcggccaccacgccttcagcgactac

SEQ ID NO: 1314 - DNA, 323 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttcgcctggcctctctactgggcctgccaagggtgcgtcctaaccggcgtctgggtcatagcccacgagtgcggccaccacgccttcagcgactac

SEQ ID NO: 1315 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctcccctggcccctctactgggcctgccaaggctgcgtcctaacgggcctctgggtcatcgcccacgaatgcggccaccacgccttcagcgactac

SEQ ID NO: 1316 - DNA, 422 bp, Artificial
  Mutation in BnaC.FAD2.b introduced by TALE nuclease pair BnFAD2_T01
caggatccatgggtgcaggtggaagaatgcaagtctaacccccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcccacttccctctcctcccccaccctctcccttaccgcgttgccggtgctgtgccaggcctacggcttgaccccggagcaggtggtggccatcgccagcaatattggtgctggcccctctactgggcctgccaaggctgcgtcctaacgggcctcggggtcatcgcccgcgaatgcggtcaccacgccttcatcgactac

SEQ ID NO: 1317 - DNA, 354 bp, Artificial
  Mutation in BnaC.FAD2.b introduced by TALE nuclease pair BnFAD2_T01
caggatccatgggtgcaggtcgaagaatgcaagtctcccctccctccagctcccccggaaccaacaccctcaaacgcgtcccctgcgagacaccaccattcactctcggagacctcaagaaagcaatcccacctcactgcttcaaacgctcgttccctcgctccttctcctacctcctcttcgacatcctcgtctcctcctccctctaccacctctccacagcctacttccctctcctcccccaccctctcccttacctcgtcgtggcccctctactgggcctgccaaggctgcgtcctaacgggcctctgggtcatcgcccacgagtgcggccaccacgccttcagcgactac

SEQ ID NO: 1318 - DNA, 394 bp, Artificial
  Mutation in BnaC.FAD2.b introduced by TALE nuclease pair BnFAD2_T01
caggatccatgggtgcaggtggaagaatgcaagtgtttcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctctaagggcgagatccggtgcagattatttggattgagagtgaatattgcccctctactgggcctgccaaggctgcgtcctaacgggcctctgggtcatagcccacgagtgcggcgaccacgccttcagcgactac

SEQ ID NO: 1319 - DNA, 354 bp, Artificial
  Mutation in BnaC.FAD2.b introduced by TALE nuclease pair BnFAD2_T01
caggatccatgggtgcaggtgcaagaatgcaagtctcccctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacttcctcgtctcctcctccctctaccacctctccacagcctacttccctctcctcccccaccctctcccttccctcgccgtggcccctctactgggcctgccaaggctgcgtcctaacgggcctctggggcatcgcccacgaatgcggccaacatgccttcagcgactac

SEQ ID NO: 1320 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttcccttggcccctctactgggcctgccaaggctgcgtcctaacgggcctctgggtcatagcccacgagtgcggccaccacgccttcagcgactac

SEQ ID NO: 1321 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccggaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccaccgctccaccgcctacttccctctcctcccccaccctctcccttaccccgccctggcccctctactgggcctgccaaggctgcgtcctaacgggcctctgggtcatagcccacgaatgcggccaccacgccttcagcgactac

SEQ ID NO: 1322 - DNA, 350 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacggcctacttccctctcctcccccaccctctcccttacccctggcccctctactgggcctgccaaggctgcgtcctaacgggcctctgggtcatcgcccacgaatgcggccaccacgccttcagcgactac

SEQ ID NO: 1323 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccgctggcccctctactgggcctgccaaggctgcgtcctaacgggcctctgggtcatcgcccacgaatgcggccaccacgccttcagcgactac

SEQ ID NO: 1324 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctccccccccaccctctcccttacctcgccctggcccctctactgggcctgccaaggctgcgtcctaacgggcctctgggtcatcgcccacgaatgcggccaccacgccttcagcgactac

SEQ ID NO: 1325 - DNA, 418 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctccttctcctcttcgacatcatcatctcctcctccctctaccacctctccacagcctacttccctctcctcccccaccctctcccttaccttgcggatttgaacgttgtgaagcaacggcccggagggtggcgggccaccacctgctggggggtcaagccgtgggcctggcccctctactgggcctgccaaggctgcgtcctaacgggcctctgggtcatcgcccacgaatgcggccaccacgccttcagcgactac

SEQ ID NO: 1326 - DNA, 350 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 1327 - DNA, 354 bp, Artificial
  Mutation in BnaC.FAD2.b introduced by TALE nuclease pair BnFAD2_T01
caggatccatgggtgcaggtggaagaatgcaagtgtcccctccatccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccctggcccctctactgggcctgccaaggctgcgtcctaacgggcctctgggtcatcgcccacgaatgcggccaccacgccttcagcgactac

SEQ ID NO: 1328 - DNA, 342 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatcccacgctccttctcctcttcgacatcatcatctcctcctcggctcctccctctaccacctctccacagcctacttccctctcctcccccaccctctcccttacctctactgggcctgccaaggctgcgtcctaacgggcctctgggtcatcgcccacgaatgcggccaccacgccttcagcgactac

SEQ ID NO: 1329 - DNA, 354 bp, Artificial
  Mutation in BnaC.FAD2.b introduced by TALE nuclease pair BnFAD2_T01
caggatccatgggtgcaggtggaagaatgcaagtctctcctccattcagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctccgcctggcccctctactaggcctgccaaggctgcgtccgaacgggcctctgggtcatcgcccacgaatgcggccaccacgccttcagcgactac

SEQ ID NO: 1330 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatagcctcctgcttctactacgtcgccaccacttacttccctctcctccctcaccctctctcctttcctggcctctctactgggcctgccagggctgcgtcctaaccggcgtctgggtcatagcccacgagtgcggccaccacgccttcagcgactac

SEQ ID NO: 1331 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttaccttggcctctctactgggcctgccaaggctgcgtcctaacgggcctctgggtcatagcccacgagtgcggccaccacgccttcagcgactac

SEQ ID NO: 1332 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccctctactgggcctgccaaggctgcgtcctaacgggcctctgggtcatcgcccacgaatgcggccaccacgccttcagcgactac

SEQ ID NO: 1333 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggaaacctcaagaaagcaatcccacctcactgcttcaaacgctccatccctcgctccttctcctacctcctcttcgacatcctcgtctcctcctccctctaccacctctccacagcctacttccctctcctcccccaccctctcccgtacctcccctctactgggcctgccaaggctgcgtcctaactggcctctgggtcatcgcccacgaatgcggccaccacgccttcagcgactac

SEQ ID NO: 1334 - DNA, 354 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagacctcaagaaagcaatcccacctcactgcttcaaacgctccatccctcgctcctcctcctacctcctcttcgacatcctcgtctcctcctccctctaccacctctccacagcctacttccctctcctcccccaccctctcccttacctcgccctggcccctctactgggcctgccaaggctgcgtcctaacgggcctctgggtcatcgcccacgaatgcggccaccacgccttcagcgactac

SEQ ID NO: 1335 - DNA, 346 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatcccacgctccttctcctacctcctcttcgacatcctcgtctcctcctccctctaccacctctccacagcctacttccctctcctcccccaccctctcccttatggcccctctactgggcctgccaaggctgcgtcctaacgggcctctgggtcatcgcccacgaatgcggccaccacgccttcagcgactac

SEQ ID NO: 1336 - DNA, 415 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctccctctaccacctctccacagcctacttccctctcctcccccaccctctcccttacctcgttgccggtgctgtgccaggcccacggcttgaccccggagcaggtggtggccatcgccagcaatattggtgctggcccctctactgggcctgccaaggctgcgtcctaacgggcctctgggtcatcgcccacgaatgcggccaccacgccttcagcgactac

SEQ ID NO: 1337 - DNA, 344 bp, Artificial
  Mutation in BnaC.FAD2.b introduced by TALE nuclease pair BnFAD2_T01
caggatccatgggtgcaggtggaagaatgcaagtgtctcctccctccaagaagcctgaaaccgacaacatcaagcgcgtaccctgcgagacaccgcccttcactgtcggagacctcaagaaagcaatcccacctcactgcttcaaacgctccatcccacgctccttctcctcttcgacatcatcatctcctcctcggctcctccctctaccacctctccacagcctacttccctctcctcccccaccctccccctggcccctctactgggcctgccaaggctgcgtcctaacgggcctctgggtcatcgcccacgaatgcggccaccacgccttcagcgactac

SEQ ID NO: 1338 - DNA, 338 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctccccccctctactgggcctgccaaggctgcgtcctaacgggcctctgggtcatcgcccacgaatgcggccaccacgccttcagcgactac

SEQ ID NO: 1339 - DNA, 343 bp, Artificial
  Mutation in BnaC.FAD2.b introduced by TALE nuclease pair BnFAD2_T01
caggatccatgggtgcaggtggaagaatgcaagtctatcctccctccagctcccccgaaaccaaaaccctcaaacgcgtcccctgcgagacaccacccttcactctcggagacctcaagaaagcaatccacctcactgcttcaaacgctccatcccacgctccttctcctacctcctcttcgacatcctcgtctcctcctccctctaccacctctccacagcctacttccctctcctccccccccctctcccttaccccctctactgggcctgccaaggctgcgtcctaacgggcctctgggtcatagcccacgagtgcggccaccacgccttcagcgactac

SEQ ID NO: 1340 - DNA, 343 bp, Artificial
  Mutation in BnaC.FAD2.b introduced by TALE nuclease pair BnFAD2_T01
caggatccatgggtgcaggtggaagagtgcaagtctatcctccctcccgctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagccacgatggcggcaagcaggcgctggagcctggcccctctactgggcctgccaaggctgcgtcctaacgggcctctgggtcatagcccacgagtgcggccaccacgccttcagcgactac

SEQ ID NO: 1341 - DNA, 322 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctcttcgacatcatcatctcctcctcggctcctccctctaccacctctccacagcctacttcctggcctctctactgggcctgccaagggtgcgtcctaaccggcgtctgggtcatagcccacgagtgcggccaccacgccttcagcgactac

SEQ ID NO: 1342 - DNA, 260 bp, Artificial
  Mutation in BnaC.FAD2.b introduced by TALE nuclease pair BnFAD2_T01
caggatccatgggtgcaggtcgaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcccttaccacgccttcagcgactac

SEQ ID NO: 1343 - DNA, 351 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctctggcccctctactgggcctgccaagggtgcgtcctaaccggcgtctgggtcatagcccacgagtgcggccaccacgccttcagcgactac

SEQ ID NO: 1344 - DNA, 380 bp, Artificial
  Mutation in BnaC.FAD2.b introduced by TALE nuclease pair BnFAD2_T01
caggatccatgggtgcaggtgaaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatagcctcctgcttctactacgtcgccaccacttacttccctctcctccctcaccctctctcctaccccggagcaggtggtggccatcgccagccacgatggcgcctggcctctctactgggcctgccagggctgcgtcctaacgggcctctgggtcatagcccacgagtgcggccaccacgccttcagcgactac

SEQ ID NO: 1345 - DNA, 303 bp, Artificial
  Mutation in BnaC.FAD2.b introduced by TALE nuclease pair BnFAD2_T01
caggatccatgggtgcaggtggaagaatgcaagtctatcctccctccagctcccccggaaccaacaccctcaaacgcgtcccctgcgagacaccaccattcactctcggagacctcaagaaagcaatcccacctcactgcttcaaacgctccatcccacgatccttctcctcttcgacatcatcatctcctcctcggctcctccctcaccctctggcctctctactgggcctgccaagggtgcgtcctaaccggcgtctgggtcatagcccacgagtgcggccaccacgccttcagcgactac

SEQ ID NO: 1346 - DNA, 351 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgctggcccctctactgggcctgccaaggctgcgtcctaacgggcgtctgggtcatagcccacgagtgcggccaccacgccttcagcgacac

SEQ ID NO: 1347 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccccgccggcccctctactgggcctgccaaggctgcgtcctaacgggcctctgggtcatagcccacgagtgcggccaccacgccttcagcgactac

SEQ ID NO: 1348 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccacaccctctcccttaccttggcccctctactgggcctgccaaggctgcgtcctaacgggcctctgggtcatcgcccacgaatgcggccaccacgccttcagcgactac

SEQ ID NO: 1349 - DNA, 345 bp, Artificial
  Mutation in BnaC.FAD2.b introduced by TALE nuclease pair BnFAD2_T01
caggatccatgggtgcaggtgcaagaatgcaagtctctcctccctccagctccaccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctaggcctctctactgggcctgccaagggtgcgtcctaaccggcgtctgggtcatagcccacgagtgcggccaccacgccttcagcgactac

SEQ ID NO: 1350 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagccacgatggcggcaagcaggcgctggagcctggcccctctactgggcctgccaaggctgcgtcctaacgggcctctgggtcatcgcccacgaatgcggccaccacgccttcagcgactac

SEQ ID NO: 1351 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctcccttacctcgcccctctactgggcctgccaaggctgcgtcctaacgggcctctgggtcatcgcccacgaatgcggccaccacgccttcagcgactac

SEQ ID NO: 1352 - DNA, 350 bp, Artificial
  Mutation in BnaC.FAD2.b introduced by TALE nuclease pair BnFAD2_T01
caggatccatgggtgcaggtggaagaatgcaagtgtctcctccatccagctccaccggaaccgacaccatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacccctggcccctctactgggcctgccaaggctgcgtcctaacgggcctctgggtcatcgcccacgaatgcggccaccacgccttcagcgactac

SEQ ID NO: 1353 - DNA, 354 bp, Artificial
  Mutation in BnaC.FAD2.b introduced by TALE nuclease pair BnFAD2_T01
caggatccatgggtgcaggtgaaagaatgcaagtctcacccccctccagctccaccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctccgcctggcccctctactgggcctgccaaggctgcgtccgaacgggcctctgggtcatcgcccgcgaatgcggccaccacgccatcagcgactac

SEQ ID NO: 1354 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcccccctctaccacctctccacagcctacttccctctcctccccctccctctccctttcctctagcccctctactgggccggccaaggctgcgtcctaacgggcctctgggtcatcgcccacgaatgcggccaccacgccatcatcgacgac

SEQ ID NO: 1355 - DNA, 348 bp, Artificial
  Mutation in BnaC.FAD2.b introduced by TALE nuclease pair BnFAD2_T01
caggatccatgggtgcaggtggaagaatgcaagtctatcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttggcctctctactgtgcctgccagggctgcgtcctaaccggcgtctgggtcatagcccacgagtgcggcctccacgccttcatcgactac

SEQ ID NO: 1356 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttggcctctctactgggcctgccagggctgcgtcctaaccggcgtctgggtcatagcccacgagtgcggccaccacgccttcagcgactac

SEQ ID NO: 1357 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccacccgctcgcctggcccctctactgggcctgccaaggctgcgtcctaacgggcctctgggtcatcgcccacgaatgcggccaccacgccatcagcgactac

SEQ ID NO: 1358 - DNA, 341 bp, Artificial
  Mutation in BnaC.FAD2.b introduced by TALE nuclease pair BnFAD2_T01
caggatccatgggtgcaggtggaagaatgcaagtctctcctccctccagctccaccggaaccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 1359 - DNA, 394 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgggagcggatttgaacgttgtgaagcaacggcccggagggtggcgggcgtctctactgggcctgccaaggctgcgtcctaacgggcctctgggtcatcgcccacgaatgcggccaccacgccttcagcgactac

SEQ ID NO: 1360 - DNA, 322 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcaagggtgcgtcctaaccggcgtctgggtcatagcccacgagtgcggccaccgcgccatcagcgactac

SEQ ID NO: 1361 - DNA, 334 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctccctctaccacctctccacagcctacttccctctcctcccccaccctctctggcctctctactgcgcctgccaagggtgcgtcctaaccggcgtctgggtcatagcccacgagtgcggccaccacgccatcagcgactac

SEQ ID NO: 1362 - DNA, 336 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctccctctaccacctctccacagcctacttccctctcctcccccaccctccctcctacctctctactgggcctgccagggctgcgtcctaaccggcgtctgggtcattgcccacgagtgcggcctccacgccttcagcgactac

SEQ ID NO: 1363 - DNA, 261 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctccgcggctcctccctctaccacctctccacagcctacttccctctcccttaccacgccttcagcgactac

SEQ ID NO: 1364 - DNA, 350 bp, Artificial
  Mutation in BnaC.FAD2.b introduced by TALE nuclease pair BnFAD2_T01
caggatcaatgggtgcaggtggaagaatgcaagtctctcctccatccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctactccctcaccctctctcctttcctggcctctctactgggcctgccagggctgcgtcctaaccggcgtctgggtcatagcccacgagtgcggccaccacgccttcagcgactac

SEQ ID NO: 1365 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctcggctcctccctctaccacctctccacagcctacttccctctcctccctcaccctctctcctagcctctctactgggcctgccaagggtgcgtcctaaccggcgtctgggtcatagcccacgagtgcggccaccacgccttcagcgactac

SEQ ID NO: 1366 - DNA, 290 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctctactgggcctgccaagggtgcgtcctaaccggcgtctgggtcatagcccacgagtgcggccaccacgccttcagcgactac

SEQ ID NO: 1367 - DNA, 358 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttccctctcctccctcaccggtttgcgtattgccggtgcctgacccctctactgggcctgccaaggctgcgtcctaacgggcctctgggtcatagcccacgagtgcggccaccacgccttcagcgactac

SEQ ID NO: 1368 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccccgcccctctactgggcctgccaaggctgcgtcctaacgggcgtctgggtcatagcccacgagtgcggccaccacgccttcagcgactac

SEQ ID NO: 1369 - DNA, 412 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttcccccgctgcagccggtccagcggctgttgccggtcctgtgccaggcccccggcttgacccctcacctggcccctctactgggcctgccaaggctgcgtcctaaccggcctctgggtcatcgcccacgaatgcggccaccacgccttcagcgactac

SEQ ID NO: 1370 - DNA, 393 bp, Artificial
  Mutation in BnaC.FAD2.b introduced by TALE nuclease pair BnFAD2_T01
caggatccatgggtgcaggtggaagaatgcaagtctctcccccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctccaacggtgcaggcgctgtggccggtgcggtgccaggcccacggctggacccctcgcctctctactgggccggccaagagtgcgtccgaaccggcgtctgggtcatagcccacgagtgcggtgaccacgccatcagcgactac

SEQ ID NO: 1371 - DNA, 338 bp, Artificial
  Mutation in BnaC.FAD2.b introduced by TALE nuclease pair BnFAD2_T01
caggatccatgggtgcaggtggaagaatgcaagtctctcctccatccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctccctctctactgggcctgccaagggtgcgtcctaaccggcgtctgggtcatagcccacgagtgcggccaccacgccttcagcgactac

SEQ ID NO: 1372 - DNA, 312 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctgggtctgccaaggctgcgtcctaacgggcctctgggtcatagcccacgagtgcggccaccacgccttcagcgactac

SEQ ID NO: 1373 - DNA, 268 bp, Artificial
  Mutation in BnaC.FAD2.b introduced by TALE nuclease pair BnFAD2_T01
caggatccatgggtgcaggtggaagaatgcaagtgtctcctccctccaagaagactgaaaccgacaccatcaagcgcgtaccctgcgagacaccgcccttcactgtcggagaactcaagaaagcaatcccaccgcactgtttcaaacgctccatccctcgctccttctcctacctcctcttcgacatcctcgtctcctcctcggctcctccctctaccacctctccacagcctacttccctctcccttaccacgccttcagcgactac

SEQ ID NO: 1374 - DNA, 358 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctcgtctggcccctctactgggcctgccaaggctgcgtcctaacgggcctctgggtcatagcccacgagtgcggccaccacgccttcagcgactac

SEQ ID NO: 1375 - DNA, 354 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctccgcctggcccctctactgggcctgccaaggctgcgtcctaacgggcctctgggtcatagcccacgagtgcggccaccacgccttcagcgactac

SEQ ID NO: 1376 - DNA, 338 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctccccctctactgggcctgccaaggctgcgtcctaacgggcctctgggtcatagcccacgagtgcggccaccacgccttcagcgactac

SEQ ID NO: 1377 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcggcccctctactgggcctgccagggctgcgtcctaaccggcgtctgggtcatagcccacgagtgcggccaccacgccttcagcgactac

SEQ ID NO: 1378 - DNA, 410 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccccaaccctctcccttacctagcggatttgtcctactcaggagagcgttcaccgacaaacaacagataaaacgaaaggccctggcccctctactgggcctgccaaggctgcgtcctaacgggcctctgggtcatcgcccacgaatgcggccaccacgccttcagcgactac

SEQ ID NO: 1379 - DNA, 480 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcctccccccccctctctgcccgcgcccgcccccccctccgcgccagcccctgcccccccccgcccccggggccaagccgtgggcctggcccacccccgccaccagccgctggaccctccccagcgcctgcttgccaccattattgctggccatcatggcccctctactgggcctgccaaggctgcgtcctaacgggcctctgggtcatcgcccacgaatgcggccaccacgccttcagcgactac

SEQ ID NO: 1380 - DNA, 401 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactacttcaaacgctccatccctcgctccttctcctacctcctcttcgacatcctcgtctcctcctccctctaccacctctccacagcctacttccctctcctcccccaccctctcccttacctagcctcgggcatccaagcagcaagcgcgttacgccgtgggtcgatgtttgactggcccctctactgggcctgccaaggctgcgtcctaacgggcctctgggtcatcgcccacgaatgcggccaccacgccttcagcgactac

SEQ ID NO: 1381 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgcccctctactgggcctgccaaggctgcgtcctaacgggcctctgggtcatagcccacgagtgcggccaccacgccttcagcgactac

SEQ ID NO: 1382 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaacaccctcaaacgcgtcccctgcgagacaccacccttcactctcggagacctcaagaaagcaatcccacctcactgcttcaaacgctccatccctcgctccttctcctacctcctcttctccatcctcctcccctcctccctccaccccccccccccagcctccttcccccccccccccctccctctcccttcccctggcccctctactgggcctgccaaggctgcgtcctaacgggcctctgggtcatcgcccacgaatgcggccaccacgccttcagcgactac

SEQ ID NO: 1383 - DNA, 342 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatcccacgctccttctcctcttcgacatcctcgtctcctcctccctctaccacctctccacagcctacttccctctcctccccccccctctcccttaccttggcccctctactgggcctgccaaggctgcgtcctaacgggcctctgggtcatcgcccacgaatgcggccaccacgccttcagcgactac

SEQ ID NO: 1384 - DNA, 342 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatcccacgctccttctcctcttcgacatcctcggctcctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 1385 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacccctctactgggcctgccaaggctgcgtcctaacgggcctctgggtcatcgcccacggatgcggccaccacgccttcagcgactac

SEQ ID NO: 1386 - DNA, 353 bp, Artificial
  Mutation in BnaC.FAD2.b introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgccggcccctctactgggcctgccaaggctgcgtcctaacgggcctctgggtcatcgcccacgaatgcggccaccacgccttcagcgactac

SEQ ID NO: 1387 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgtgtcatcgcccacgaatgcggccaccacgccttcagcgactac

SEQ ID NO: 1388 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctcgcccttacccctctaccgggcctgccaaggctgcgtcctaacgggcctctgggtcatagcccacgagtgcggccaccacgccttcagcgactac

SEQ ID NO: 1389 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctctctggcccctctactgggcctgccaaggctgcgtcctaacgggcctctgggtcatcgcccacgaatgcggccaccacgccttcagcgactac

SEQ ID NO: 1390 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccgcctcactgcttcaaacgctccatcccacgctccttctcctcttcgacatcatcatctcctcctcggctcctccctctaccacctctccacagcctacttccctctcctccccccccccctcccttacctggcccctctactgggcctgccaaggctgcgtcctaacgggcctctgggtcatagcccacgagtgcggccaccacgccttcagcgactac

SEQ ID NO: 1391 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctcccctgccctctactgggcctgccaaggctgcgtcctaacgggcctctgggtcatcgcccacgaatgcggccaccacgccttcagcgactac

SEQ ID NO: 1392 - DNA, 261 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgatacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttaccacgccttcagcgactac

SEQ ID NO: 1393 - DNA, 348 bp, Artificial
  Mutation in BnaC.FAD2.b introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactcccggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttggcctctctactgggcctgccagggctgcgtcctaaccggcgtctgggtcatagcccacgagtgcggccaccacgccttcagcgactac

SEQ ID NO: 1394 - DNA, 357 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcatcatctcctcctcggctcctccctctaccacctctccacagcctacttccctctcctcccccaccctctcccttaccttggcccctctactgggcctgccaaggctgcgtcctaacgggcctctgggtcatagcccacgagtgcggccaccacgccttcagcgactac

SEQ ID NO: 1395 - DNA, 350 bp, Artificial
  Mutation in BnaC.FAD2.b introduced by TALE nuclease pair BnFAD2_T01
caggatccaggggtgcaggtggaaggatgcaagtgtctcctccctccaagaagtatgaaaccgacaccatcaagcgcgtaccctgcgagacaccgcccttcactgtcggagaactcaagaaagcaatcccacctcactgcttcaaacgctccatcccacgctccttctcctcttcgacatcatcatctcctcctcggctcctccctctaccacctctccacagcctacttccctctcctccccctccctctcccttacctcggcccctacactggtcctcccaaggctgcgtcctatcgggcctctgggtcatcacccacgaatgcggccaccacgccttcagcgcctac

SEQ ID NO: 1396 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctccccccccaccctctcccttaccttggcccctctactgggcctgccaaggctgcgtcctaacgggcctctgggtcatcgcccacgaatgcggccgccacgccttcagcgactac

SEQ ID NO: 1397 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccggcccctctactgggcctgccaaggctgcgtcctaacgggcctctgggtcatcgcccacgaatgcggccaccacgccttcagcgactac

SEQ ID NO: 1398 - DNA, 345 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccaccattcactctcggagacctcaagaaagcaatcccacctcactgcttcaaacgctccatccctcgctccttctcctacctcctcttcgacatcctcgtctcctcctccctctaccacctctccacaccctacttccctctcctccctcaccctctcgcctacgcctctctaccgggccagccaagggtgcgtcctacccggcgtctgggtcatagcccacgagtgctgccaccacgccatcagcgactcc

SEQ ID NO: 1399 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcgtagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccctctactgggcctgccaaggctgcgtcctaacgggcctctgggtcatcgcccacgaatgcggccaccacgccttcagcgactac

SEQ ID NO: 1400 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgccatcctcgtctcctcctccctctaccacctctccacagcctacttccctctcctccccctccctctctcctactttggcctctctactgggcctgccaagggtgcgtcctaaccggcgtctgggtcatagcccacgaatgcggccaccacgccttcagcgactac

SEQ ID NO: 1401 - DNA, 353 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatcccacgctccttctcctcttcgacatcatcatctcctcctcggctcctccctctaccacctctccacagcctacttccctctcctcccccaccctctcccttacccccctggcccctctactgggcctgccaaggctgcgtcctaacgggcctctgggtcatcgcccacgaatgcggccaccacgccttcagcgactac

SEQ ID NO: 1402 - DNA, 340 bp, Artificial
  Mutation in BnaC.FAD2.b introduced by TALE nuclease pair BnFAD2_T01
caggatccatgggtgcaggtggaagaatgcaagtctctcctccctccagctaccccgaaaccaaaaacctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccacccgcctggcccctctactgggcctgccaaggctgcgtcctaacgggcctctgggtcatagcccacgagtgcggccaccacgccttcagcgactac

SEQ ID NO: 1403 - DNA, 381 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccacaccctctcacttacctcgctcgccgcagccgaacgcccgagcgcagcgtggcccctctactgggcctgccaaggctgcgtcctaacgggcctctgggtcatcgcccacgaatgcggccaccacgccttcagcgactac

SEQ ID NO: 1404 - DNA, 261 bp, Artificial
  Mutation in BnaC.FAD2.b introduced by TALE nuclease pair BnFAD2_T01
caggatccatgggtgcaggtggaagaatgcaagtctctcctccctccaagaagtctgaaaccgacaccatcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttccctctcccttaccacgccttcagcgactac

SEQ ID NO: 1405 - DNA, 340 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatagcctcctgcttctactacgtcgccaccacttacttccctctcctccctcaccctctctcctacttccctctctactgggcctgccaaggctgcgtcctaacgggcctctgggtcatagcccacgagtgcggccaccacgccttcagcgactac

SEQ ID NO: 1406 - DNA, 350 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaattccaccgcactgtttcaaacgctccatccctcgctccttctcctacctcctcttcgacatcctcgtctcctcctccctctaccacctctccacagcctacttccctctcctcccccgccctcccccttccctctggcccctctactgggcctgccaaggctgcgtcctaacgggcctctgggtcatagcccacgagtgcggccaccacgccttcagcgactac

SEQ ID NO: 1407 - DNA, 340 bp, Artificial
  Mutation in BnaC.FAD2.b introduced by TALE nuclease pair BnFAD2_T01
aaggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatagcctcctgcttctactacgtcgccaccacttacttccctctcctccctcaccctctctcctacttccctctctactgggcctgccaaggctgcgtcctaacgggcctctgggtcatagcccacgagtgcggccaccacgccttcagcgactac

SEQ ID NO: 1408 - DNA, 346 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttccctcccctcgactgggcctgccaaggctgcgtcctaacgggcctctgggtcatcgcccacgaatgcggccaccacgccttcagcgactac

SEQ ID NO: 1409 - DNA, 350 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagacctcaagaaagcaatcccacctcactgcttcaaacgctccatcccacgctccttctcctcttcgacatcatcatctcctcctcgtctcctcctccctctaccacctctccacagcctacttccctctcctcccccaccctctcccttatggcccctctactgggcctgccaaggctgcgtcctaacgggcctctgggtcatcgcccacgaatgcggccaccacgccttcagcgactac

SEQ ID NO: 1410 - DNA, 338 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatcccacgctccttctcctcttcgacatcatcatagcctcctgcttctactacgtcgccaccacttacttccctctcctccctcaccctctctcctacttctctctactgggcctgccaagggtgcgtcctaaccggcgtctgggtcatagcccacgagtgcggccaccacgccttcagcgactac

SEQ ID NO: 1411 - DNA, 343 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatactcgtctcctcctccctctaccacctctccacagcctacttccctctcctcccccaccctcccccttacccctctactgggcctgccaaggctgcgtcctaacgggcctctgggtcatcgcccacgaatgcggccaccacgccttcagcgactac

SEQ ID NO: 1412 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccccctcccttccctcccctctactgggcctgccaaggctgcgtcctaacgggcctctgggtcatcgcccacgaatgcggccaccacgccttcagcgactac

SEQ ID NO: 1413 - DNA, 355 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctccccctgccctcacgcctggcccctctactgggcctgccaaggctgcgtcctaacgggcctctgggtcatagcccacgagtgcggccaccacgccttcagcgactac

SEQ ID NO: 1414 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccctccctctcccttccccctggcccctctactgggcctgccaaggctgcgtcctaacgggcctctgggtcatcgcccacgaatgcggccaccacgccttcagcgactac

SEQ ID NO: 1415 - DNA, 345 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccctacctccctctactgggcctgccaaggctgcgtcctaacgggcctctgggtcatcgcccacgaatgcggccaccacgccttcagcgactac

SEQ ID NO: 1416 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttaactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacccctctactgggcctgccaaggctgcgtcctaacgggcctctgggtcatcgcccgcgaatgcggccaccacgccttcagcgactac

SEQ ID NO: 1417 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcctcttcgacatcctcgtctcctcctccctctaccacctctccacagcctacttccctctcctccctcaccctctctcctacctctctactgggcctgccaagggtgcgtcctaaccggcgtctgggtcatagcccacgagtgcggccaccacgccttcagcgactac

SEQ ID NO: 1418 - DNA, 350 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatagcccacgagtgcggccaccacgccttcagcgactac

SEQ ID NO: 1419 - DNA, 345 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctccctctactgggcctgccaaggctgcgtcctaacgggcgtcttggtcatagcccacgagtgcggccaccacgccttcagcgactac

SEQ ID NO: 1420 - DNA, 338 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgcttcaaacgctccatcccacgctccttctcctcttcgacatcatcatctcctcctcggctcctccctctaccacctctccacagcctacttccctctcccttacctcgcctgaccctctactgggcctgccaaggctgcgtcctaacgggcctctgggtcatagcccacgaatgcggccaccacgccttcagcgactac

SEQ ID NO: 1421 - DNA, 348 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 1422 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacactaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctctactgggcctgccaaggctgcgtcctaacgggcctctgggtcatcgcccacgaatgcggccaccacgccttcagcgactac

SEQ ID NO: 1423 - DNA, 356 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctcgccgcctggcccctctactgggcctgccaaggctgcgtcctaacgggcctctgggtcatcgcccacgaatgcggccaccacgccttcagcgactac

SEQ ID NO: 1424 - DNA, 350 bp, Artificial
  Mutation in BnaC.FAD2.b introduced by TALE nuclease pair BnFAD2_T01
caggatccattggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 1425 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccctggcccctctactgggcctgccaaggctgcgtcctaacgggcctctgggtcatcgcccacgaatgcggccaccacgccttcagcgactac

SEQ ID NO: 1426 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 1427 - DNA, 401 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgatccatcccacgctccttctcctacctcctcttcgacatcctcgtctcctcctccctctaccacctctccacagcctacttccctctcctccctcaccctctctcctacttcgccataaactgccaggcatcaaactaagcagaaggccatccgtccataggctggcctctctactgggcctgccaagggtgcgtcctaaccggcgtctgggtcatagcccacgagtgcggccaccacgccttcagcgactac

SEQ ID NO: 1428 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaagggtgcgtcctaacgggcctctgggtcatagcccacgagtgcggccaccacgccttcagcgactac

SEQ ID NO: 1429 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacattggcccctctactgggcctgccaaggctgcgtcctaacgggcctctgggtcatcgcccacgaatgcggccaccacgccttcagcgactac

SEQ ID NO: 1430 - DNA, 326 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccacctcactgcttcaaacgctccatcccacgctccttctcctacctcctcttcgacatcatcatctcctcctccctctaccccctctccacagcctacttccctctcctccccctctactgggcctgccaaggctgcgtcctaacgggcctctgggtcatcgcccacgaatgcggccaccacgccttcagcgactac

SEQ ID NO: 1431 - DNA, 349 bp, Artificial
  Mutation in BnaC.FAD2.b introduced by TALE nuclease pair BnFAD2_T01
caggatccatgggtacaggtggaagaatgcaagtctcccctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccccctcccttacattggcccctctactgggcctgccaaggctgcgtcctaacgggcctctgggtcatcgcccacgaatgcggccaccacgccttcagcgactac

SEQ ID NO: 1432 - DNA, 313 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctcaccctctctcctactttggcctctctactgggcctgccagggctgcgtcctaaccggcgtctgggtcatagcccacgagtgcggccaccacgccttcagcgactac

SEQ ID NO: 1433 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctccccctgacccctctactgggcctgccaaggctgcgtcctagcgggcctctgggtcatcgcccacgaatgcggccaccacgccttcagccactac

SEQ ID NO: 1434 - DNA, 347 bp, Artificial
  Mutation in BnaC.FAD2.b introduced by TALE nuclease pair BnFAD2_T01
caggtccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgccccttctcctacctcctcttcgacatcctcgtctcctcctccctccaccacctccccacaccctacttccctctcctcccccaccctctcccttacctggcccctctactgggcctgccaaggctgcgtcctaacgggcctctgggtcatcgcccacgaatgcggccaccacgccttcagcgactac

SEQ ID NO: 1435 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagccacgatggcggcaagcaggcgctggagcctggcccctctactgggcctgccaaggctgcgtcctaacgggcctctgggtcatcgcccacgaatgcggccaccacgccttcagcgactac

SEQ ID NO: 1436 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacacgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccccctcccttacctctactgggcctgccaaggctgcgtcctaacgggcctctgggtcatcgcccacgagtgcggccaccacgccttcagcgactac

SEQ ID NO: 1437 - DNA, 352 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctccctggcccctctactgggcctgccaaggctgcgtcctaacgggcctctgggtcatcgcccacgaatgcggccaccacgccttcagcgactac

SEQ ID NO: 1438 - DNA, 350 bp, Artificial
  Mutation in BnaC.FAD2.b introduced by TALE nuclease pair BnFAD2_T01
caggatccatgggtgcaggtggaagaatgcaagtctctcctccatccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 1439 - DNA, 356 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgccgcctggcccctctactgggcctgccaaggctgcgtcctaacgggcctctgggtcatcgcccacgaatgcggccaccacgccttcagcgactac

SEQ ID NO: 1440 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctctactgggcctgccaaggctgcgtcctaacgggcctctgggtcatcgcccaccaatgcggccaccacgccttcagcgactac

SEQ ID NO: 1441 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacaccctacttccctctcctcccccaccctctcccttacctcgccctggcccctctactgggcctgccaaggctgcgtcctaacgggcctctgggtcatcgcccacgaatgcggccaccacgccttcagcgactac

SEQ ID NO: 1442 - DNA, 410 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctagcggatttgtcctactcaggagagcgttcaccgacaaacaacagataaaacgaaaggccctggcccctctactgggcctgccaaggctgcgtcctaacgggcctctgggtcatcgcccacgaatgcggccaccacgccttcagcgactac

SEQ ID NO: 1443 - DNA, 319 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccaccccacgctccttctcctcttcgacatcctcgtctcctcctccctctaccacctctccacagcctacttccctctcctccccctctactgggcctgccagggctgcgtcccaaccggcgtctgggtcatagcccacgagtgcggccaccacgccttcagcgactac

SEQ ID NO: 1444 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctccctcaccctctctcctggcctctctactgggcctgccaagggtgcgtcctaaccggcgtctgggtcatagcccacgagtgcggccaccacgccttcagcgactac

SEQ ID NO: 1445 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacccctggcccctctactgggcctgccaaggctgcgtcctaacgggcctctgggtcatcgcccacggatgcggccaccacgccttcagcgactac

SEQ ID NO: 1446 - DNA, 312 bp, Artificial
  Mutation in BnaC.FAD2.b introduced by TALE nuclease pair BnFAD2_T01
caggatccatgggtgcagggggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctgggtctgccaaggctgcgtcctaacgggcctctgggtcatcgcccacgaatgcggccaccacgccttcagcgactac

SEQ ID NO: 1447 - DNA, 381 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgctcgccgcagccgaacgaccgagcgcagcgtggcccctctactgggcctgccaaggctgcgtcctaacgggcctcttggtcatcgcccacgaatgcggccaccacgccttcagcgacta

SEQ ID NO: 1448 - DNA, 355 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctccatcctggcccctctactgggcctgccaaggctgcgtcctaaccggcgtctgggtcatagcccacgagtgcggccaccacgccttcagcgactac

SEQ ID NO: 1449 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacatcaccattcacactcggagacctcaagaaagcaatcccacctcactgcttcaaacgctccatccctcgctccttctcctacctcctcttcgacatcctcgtctcctcctccctctaccacctctccacaacctacttccctctcctcccccaccctctcccgcaagacccccctgccgcgcctgccaaggctgcgtcctcacgggcctctgggtcatcgcccacgaatgcggccaccacgccttcagcgactcc

SEQ ID NO: 1450 - DNA, 337 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctcgcccctctactgggcctgccaaggctgcgtcctaacgggcctctgggtcatcgcccacgaatgcggccaccacgccttcagcgactac

SEQ ID NO: 1451 - DNA, 349 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatagcccacgagtgcggccaccacgccttcagcgactac

SEQ ID NO: 1452 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagccacgatggcggcaagcaggcgctggagcctggcccctctactgggcctgccaaggctgcgtcctaaccggcgtctgggtcatagcccacgagtgcggccaccacgccttcagcgactac

SEQ ID NO: 1453 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctctcctacttggcctctctactgggcctgccagggctgcgtcctaaccggcgtcagggtcatagcccacgagtgcggccaccacgccttcagcgactac

SEQ ID NO: 1454 - DNA, 358 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttccctcgcctcgtctggcccctctactgggcctgccaaggctgcgtcctaacgggcctctgggtcatcgcccacgaatgcggccaccacgccttcagcgactac

SEQ ID NO: 1455 - DNA, 306 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctcaccctctctcctacctctctactgggcctgccaagggtgcgtcctaaccggcgtctgggtcatagcccacgagtgcggccaccacgccttcagcgatac

SEQ ID NO: 1456 - DNA, 337 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctcttcgacatcatcatctcctcctctgctcctccctctaccacctctccacagcctacttccctctcccttacctcgctggcccctctactggcctgccaaggctgcgtcctaaccggcgtctgggtcatagcccacgagtgcggccaccacgccttcagcgactac

SEQ ID NO: 1457 - DNA, 439 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctaggtccagcgcctgcttgccgccatcgtggctggcgatggccaccacctgctccggggtcaagccgtgggcctggcacagcaccggcaagcaggcgctgtctctactgggcctgccagggctgcgtcctaaccggcgtctgggtcatagcccacgagtgcggccaccacgccttcagcgactac

SEQ ID NO: 1458 - DNA, 309 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctcaccctctctcctactcctctctactgggcctgccaagggtgcgtcctaaccggcgtctgggtcatagcccacgagtgcggccaccacgccttcagcgactac

SEQ ID NO: 1459 - DNA, 355 bp, Artificial
  Mutation in BnaC.FAD2.b introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctcccctcgcgcctggcccctctactgggcctgccaaggctgcgtcctaacgggcctctgggtcatcgcccacgaatgcggccaccacgccttcagcgactac

SEQ ID NO: 1460 - DNA, 312 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatccaacctcactgcttcaaacgctccatccctcgctccttctcctacctcctcttcgacatcctcgtctcctcctccctctaccacctctccacagcctacttccctctgggtctgccaaggctgcgtcctaacgggcctctgggtcatcgcccacgaatgcggccaccacgccttcagcgactac

SEQ ID NO: 1461 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgccctggcccctctactgggcctgccaaggctgcgtcctaacgggcctctgggtcatcgcccacgagtgcggccaccacgccttcagcgactac

SEQ ID NO: 1462 - DNA, 317 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttcctctctactgggcctgccaagggtgcgtcctaaccggcgtctgggtcatagcccacgagtgcggccaccacgccttcagcgactac

SEQ ID NO: 1463 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgctggcccctctactgggcctgccaaggctgcgtcctaacgggcctctgggtcatcgcccacgaatgcggccaccacgccttcagcgactac

SEQ ID NO: 1464 - DNA, 387 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccaacggctgataggatcccccaatccctttttcactgcatctggcccctctactgggcctgccaaggctgcgtcctaacgggcctctgggtcatcgcccacgagtgcggccaccacgccttcagcgactac

SEQ ID NO: 1465 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcccaggcccctctactgggccggccaaggctgcgtcctaacgggcctctgggtcagcgcccacgaatgcggccaccacgccttcagcgactac

SEQ ID NO: 1466 - DNA, 349 bp, Artificial
  Mutation in BnaC.FAD2.b introduced by TALE nuclease pair BnFAD2_T01
caggatccatgggtgcaggtggaagaatgcaagtctctcctcccccccgctcccccgaaaccaaaaccctcaaactcgtcccctgcgagccaccacccttcactctcggagacctcaagaaagcaatcccacctcactgcttcaaacgctcgatccctcgctccttctcctacctcctcttcgacatcctcgtctcctcctccctctaccacctctccacagcctacttccctctcctcccccaccctctcccttaccttggcccctctactgggcctgccaaggctgcgtcctaaccggcgtctgggtcatagcccacgagtgcggccaccacgccttcagcgactac

SEQ ID NO: 1467 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctggcccctctactgggcctgccaaggctgcgtcctaacgggcctctgggtcatcgcccacgaatgcggccaccacgccttcagcgactac

SEQ ID NO: 1468 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctccttggcctctctactgggccggccaagggtgcgtcctaaccggcgtctgggtcatagcccacgagtgcggccaccacgccttcagcgactac

SEQ ID NO: 1469 - DNA, 350 bp, Artificial
  Mutation in BnaC.FAD2.b introduced by TALE nuclease pair BnFAD2_T01
caggatccatgggtgcaggtggaagaatgcaagtctctcctccctacagctccaccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctccccccccgccctctcccttacctcggcccctcttctgcgcctgccaaggctccgtcctaacgggcctctgggtcatagcccacgagtgcggccaccacgccctcagcgactac

SEQ ID NO: 1470 - DNA, 340 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccacccgcctggcccctctactgggcctgccaaggctgcgtcctaacgggcctctgggtcatagcccacgagtgcggccaccacgccttcagcgactac

SEQ ID NO: 1471 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttttggcctctctactgggcctgccaagggtgcgtcctaaccggcgtctgggtcatagcccacgagtgcggccaccacgccttcagcgactac

SEQ ID NO: 1472 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgagtgcggccaccacgccttcagcgactac

SEQ ID NO: 1473 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 1474 - DNA, 338 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatccctcgctccttctcctacctcctcttcgacatcctcgtctcctcctccctctaccacctctccacagcctacttccctctcctcccccaccctctccccctctactgggcctgccaaggctgcgtcctaacgggcctctgggtcagcgcccacgaatgcggccaccacgccttcagcgactac

SEQ ID NO: 1475 - DNA, 347 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctactggcctctctactgggcctgccaagggtgcgtcctaaccggcgtctgggtcatagcccacgagtgcggccaccacgccttcagcgactac

SEQ ID NO: 1476 - DNA, 422 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccgacacagcccagcttggagcgaacgacctacaccgaactgagatacctacagcgtgagctatgagaaagcgccacgctatggcccctctactgggcctgccaaggctgcgtcctaacgggcctcggggtcatcgcccacgaatgctgccaccacgccttcagcgactac

SEQ ID NO: 1477 - DNA, 348 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 1478 - DNA, 355 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcagacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgccctggcccctctactgggcctgccaaggctgcgtcctaacgggcctctgggtcatcgcccacgaatgcggccaccacgccttcagcgactac

SEQ ID NO: 1479 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttaccttggcccctctactgggcctgccaaggctgcgtcctaacgggcgtctgggtcatagcccacgagtgcggccaccacgccttcagcgactac

SEQ ID NO: 1480 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgccctggcccctctactgggcctgccaagggtgcgtcctaacgggcctctgggtcatagcccacgagtgcggccaccacgccttcagcgactac

SEQ ID NO: 1481 - DNA, 472 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcgtctcctcctccctctaccacctctccacagcctacttccctctcctcccccacccccccccttaccttgaggggtcaagccgtgggcctggcacagcaccggcaacagcgccttcaccttttgtatacaaagttgttgcatgcaggcctctgcaggggcaagcacctgggcggctccaggaagccctggcccctctactgggcctgccaaggctgcgtcctaacgggcctctgggtcatcgcccacgaatgcggccaccacgccttcagcgactac

SEQ ID NO: 1482 - DNA, 472 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcgtctcctcctccctctaccacctctccacagcctacttccctctcctcccccaccccctcccttcccttgagggttcaagccgtgggcctggcacagcaccggcaccagcgccttcaacttttgtatacaaagttgttgcatgcaggcctctgcaggggcaagcacctgggcggctccaggaagccctggcccctctactgggcctgccaaggctgcgtcctaacgggcctctgggtcatcgcccacgaatgcggccaccacgccttcagcgactac

SEQ ID NO: 1483 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacccctggcccctctactgggcctgccaaggctgcgtcctaacgggcctctgggtcatagcccacgagtgcggccaccacgccatcagcgactac

SEQ ID NO: 1484 - DNA, 326 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcctccccctctactgggcctgccaaggctgcgtcctaacgggcctctgggtcatcgcccacgaatgcggccaccacgccttcagcgactac

SEQ ID NO: 1485 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctgacctggcccctctactgggcctgccaaggctgcgtcctaacgggcctctgggtcatcgcccacgaatgcggccaccacgccgtcagcgactac

SEQ ID NO: 1486 - DNA, 348 bp, Artificial
  Mutation in BnaC.FAD2.b introduced by TALE nuclease pair BnFAD2_T01
caggatccatgagtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctcacctggcccctctactgggcctgccaaggctgcgtcctaacgggcctcttggtcatcgcccacgaatgcggccaccacgccttcagcaactac

SEQ ID NO: 1487 - DNA, 253 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaattccacctcactgcttcaaacgctccatcccacgctccttctcctcttcgacatcctcgtctcctcctccctctaccacctctccacagcctacttccctctcccttaccacgccttcagcgactac

SEQ ID NO: 1488 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaaaaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctccccctctcccctactgggcctctctactgggcctgccagggctgcgtcctaaccggcgtctgggtcatagcccacgagtgcggccaccacgccttcagcgactac

SEQ ID NO: 1489 - DNA, 349 bp, Artificial
  Mutation in BnaC.FAD2.b introduced by TALE nuclease pair BnFAD2_T01
caggatccatgggtgcatgtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 1490 - DNA, 347 bp, Artificial
  Mutation in BnaC.FAD2.b introduced by TALE nuclease pair BnFAD2_T01
caggatccatgggtgcaggtggaagaatgcaagtctctcctccctcccgctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccatcccagcccctctactgggcctgccaaggctgcgtcctaactggcctctggttcatcgcccacgaatgcggccaccacgccatcagcgactac

SEQ ID NO: 1491 - DNA, 372 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctctccagcggctgttgccgccatcgtgcccctctactgggcctgccaaggctgcgtcctaacgggcctctgggtcatcgcccacgagtgcggccaccacgccttcagcgactac

SEQ ID NO: 1492 - DNA, 329 bp, Artificial
  Mutation in BnaC.FAD2.b introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgcttcaaacgctccatcccacgctccttctcctcttcgacatcatcatctcctcctccctctaccacctctccacagcctacctccctctcctcccccaccccctccctttcctgggcctgccaaggctgcgtcctaacgggcctctgggtcatcgcccacgaatgcggccaccacgccttcagcgactac

SEQ ID NO: 1493 - DNA, 347 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcgtagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttccctgcccctctactgggcctgccaaggctgcgtcctaacgggcgtctgggtcatagcccacgagtgcggccaccacgccttcagcgactac

SEQ ID NO: 1494 - DNA, 299 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctcaccctctctcctactgggcctgccagggctgcgtcctaaccggcgtctgggtcatagcccacgagtgcggccaccacgccttcagcgactac

SEQ ID NO: 1495 - DNA, 338 bp, Artificial
  Mutation in BnaC.FAD2.b introduced by TALE nuclease pair BnFAD2_T01
caggatccatggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctcaccccctctactgggcctgccaaggctgcgtcctaacgggcctctgggtcatcgcccacgaatgcggccaccacgccttcagcgactac

SEQ ID NO: 1496 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctctttgacatcctcgtctcctcctccctctaccacctctccacagcctacttccctctcctcccccaccctctcccttaccttggcccctctactgggcctgccaaggctgcgtcctaacgggcctcggggtcatagcccacgagtgcggccaccacgccttcagcgactac

SEQ ID NO: 1497 - DNA, 372 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctctccagcggctgttgccgccatcgtgcccctctactgggcctgccaaggctgcgtcctaacgggcctctgggtcatcgcccacgaatgcggccaccacgccttcagcgactac

SEQ ID NO: 1498 - DNA, 342 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 1499 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacccctggcccctctactgggcctgccaaggctgcgtcctaacgggcctctgggtcatagcccacgagtgcggccaccacgccttcagcgactac

SEQ ID NO: 1500 - DNA, 311 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggcgacctcaagaaagcaatcccacctcactgcttcaaacgctccatccctcgctccttctcctacctcctcttcgacatcctcgtctcctcctccctcaccctctctcctacttcgcctctctactgggcctgccagggctgcgtcctaaccggcgtctgggtcatagcccacgagtgcggccacctcgccttcagcgactac

SEQ ID NO: 1501 - DNA, 331 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcgagaaagcaatcccacctcactgcttcaaacgctccatccctcgctccttctcctacctcctcttcgacatcctcgtctcctcctccctctaccacctctccacagcctacttccctctcctccctggcccctctactgggcctgccaaggctgcgtcctaacgggcctctgggtcatcgcccacgaatgcggccaccacgccttcagcgactac

SEQ ID NO: 1502 - DNA, 345 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctcccctactcctctctactgggcctgccagggctgcgtcctaaccggcgtctgggtcatagcccacgagtgcggccaccacgccttcagcgactac

SEQ ID NO: 1503 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcgcctggcccctctactgggcctgccaaggctgcgtcctaacgggcctctgggtcatagcccacgagtgcggccaccacgccttcagcgactac

SEQ ID NO: 1504 - DNA, 348 bp, Artificial
  Mutation in BnaC.FAD2.b introduced by TALE nuclease pair BnFAD2_T01
caggatccatgggtgcaggcggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggcttcgtcctaacgggcctctgggtcatcgcccacgaatgtggccaccgcgccatcagcgactac

SEQ ID NO: 1505 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatcccacgctccttctcctcttcgacatcatcatctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 1506 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacccccctggcccctctactgggcctgccaaggctgcgtcctaacgggcctctgggtcatcgcccacgaatgcggccaccacgccttcagcgactac

SEQ ID NO: 1507 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctggcctctctactgggcctgccagggctgcgtcctaaccggcgtctgggtcatagcccacgagtgcggccaccacgccttcagcgactac

SEQ ID NO: 1508 - DNA, 349 bp, Artificial
  Mutation in BnaC.FAD2.b introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 1509 - DNA, 374 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctactccaggcttatcttggacaagaagaagatcgctctctactgggcctgccaagggtgcgtcctaacgggcctctgggtcatcgcccacgaatgcggccaccacgccttcagcgactac

SEQ ID NO: 1510 - DNA, 324 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcctcgtctcctcctccctctaccacctctccacagcctacttccctctcctccctggcccctctactgggcctgccaaggctgcgtcctaaccggcgtctgggtcatagcccacgagtgcggccaccacgccttcagcgactac

SEQ ID NO: 1511 - DNA, 350 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactctcggagacctcaagaaagcaatcccacctctctgcttcaaacgctccatccctcgctccttctcctacctcctcttcgacatcctcgtctcctcctccctctaccacctctccacagcctacttccctctcttcccccacccgctcccttccctctggcccctctactgggcctgccaaggctgcgtcctaacgggcctctgggtcatcgcccacgaatgcggccaccacgccttcagcgactac

SEQ ID NO: 1512 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctggcccctctactgggcctgccaaggctgcgtcctaacgggcctctgggtcatcgcccacgaatgcagccaccacgccttcagcgactac

SEQ ID NO: 1513 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttccacatcatcctctcctcctcggctcctccctctaccacctctccacagcctacttccctctcctccctcaccctctctcctactttggcctctctactgggcctgccagggctgcgtcctaaccggcgtctgggtcatagcccacgagtgcggccaccacgccttcagcgactac

SEQ ID NO: 1514 - DNA, 373 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctccagcgcctgcttgccgccatcgtgcccctctactgggcctgccaaggctgcgtcctaacgggcctctgggtcatcgcccacgaatgcggccaccacgccttcagcgactac

SEQ ID NO: 1515 - DNA, 350 bp, Artificial
  Mutation in BnaC.FAD2.b introduced by TALE nuclease pair BnFAD2_T01
caggatccatgggtgcaggtggaagaatgcaagtgtctcctccctccaagaagcctgaaaccgacaccatcaagcgcgtaccctgcgagccaccgcccttcactgtcggagaactcaagcaagcaatcccacctcactgcttcaaacgctccatcccacgctccttctcctacctcctcttcgacatcctcgtctcctcctccctctacaacctctcccccgcctacttccctctcctcccccaccctctcccttacccctggcccctctactgggcctgccaaggctgcgtcttaacgggcctctgggtcatagcccacgagtgcggccaccacgccttcagcgactac

SEQ ID NO: 1516 - DNA, 351 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttctggcctctctactgggcctgccaagggtgcgtcctaaccggcgtctgggtcatagcccacgagtgcggccaccacgccctcagcgactac

SEQ ID NO: 1517 - DNA, 331 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctggcccctctactgggcctgccagggctgcgtcctaaccggcgtctgggtcatagcccacgagtgcggccaccacgccttcagcgactac

SEQ ID NO: 1518 - DNA, 356 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctctcgcctacttcgccgcctggcctctctactgggcctgccagggctgcgtcctaaccggcgtctgggtcatagcccgcgagtgcggccaccacgccatcagcgactac

SEQ ID NO: 1519 - DNA, 356 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctccctccttctcctacctcctcttcgacatcctcgtctcctcctccctctaccacctctccacagcctacttccctctcctcccccaccctctcccttccctcgccgcctggcccctctactgggcctgccaaggctgcgtcctaacgggcctctgggtcatcgcccacgaatgcggccaccacgccttcagcaactac

SEQ ID NO: 1520 - DNA, 337 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccctctactgggcctgccaaggctgcgtcctaacgggcctctgggtcatcgcccacgaatgcggccaccacgccttcagcgactac

SEQ ID NO: 1521 - DNA, 337 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccctctactgggcctgccaaggctgcgtcctaacgggcctctgggtcatcgcccacgaatgcggccaccacgccttcagcgactac

SEQ ID NO: 1522 - DNA, 381 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgctcgccgcagccgaacgaccgagcgcagcgtggcccctctactgggcctgccaaggctgcgtcctaacgggcctcggggtcatcgcccacgaatgcggccaccacgccttcagcgactac

SEQ ID NO: 1523 - DNA, 298 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctcaccctctctctactgggcctgccaaggctgcgtcctaacgggcctctgggtcatcgccctcgaatgcggccaccacgccttcagcgactac

SEQ ID NO: 1524 - DNA, 481 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctcccctaccaccgcctctggcgcccatcgcgcctggcgctggcccccccctgccccggggccaacccgtgggccgggcacacccccggcaacagccgctggcccgtctccagcgccggcttgccaccattattgctggccatcatggcccctctactgggcctgccaaggctgcgtcctaacgggcctctgggtcatcgcccacgaatgcggccaccacgccttcagcgactac

SEQ ID NO: 1525 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatccaacctcactgcttcaaacgctccatccctcgctccttctcctacctcctcttcgacatcctcgtctcctcctccctctaccacctctccacagcctacttccctctcctcccccaccctctcccttacctcggcccctctactgggcctgccaaggctgcgtcctaacgggcctctgggtcatcgcccacgaatgcggccaccacgccttcagcgactac

SEQ ID NO: 1526 - DNA, 313 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctcaccctctctcctactttggcctctctactgggcctgccaagggtgcgtcctaaccggcgtctgggtcatagcccacgagtgcggccaccacgccttcagcgactac

SEQ ID NO: 1527 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctccgcctggcccctctactgggccggccaaggctgcgtcctaacgggcctctgggtcatagcccacgattgcggccaccacgccttcagcgactac

SEQ ID NO: 1528 - DNA, 356 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccccctcccttacctcgccacctggcccctctactgggcctgccaaggctgcgtcctaacgggcctctgggtcatcgcccacgaatgcggccaccacgccttcagcgactac

SEQ ID NO: 1529 - DNA, 340 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttacctcgccctggcccctctactgcgcctgccaaggctgcgtcctaacgggcctctgggtcatcgcccacgaatgcggccaccacgccttcagcgactac

SEQ ID NO: 1530 - DNA, 325 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaattccacctcactgcttcaaacgctccatccctcgctccttctcctacctcctcttcgacatcctcgtctcctcctccctctaccacctctccacagcctacttccctctcctcccccaccctctctcctacttggctgcgtcctaaccggcgtctgggtcatagcccacgagtgcggccaccacgccttcagcgactac

SEQ ID NO: 1531 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctccctctaccacctctccacagcctacttccctctcctcccccaccctctcccttacctcgccgcctggcctctctactgggcctgccaaggctgcgtcctaacgggcctctgggtcatcgcccacgaatgcggccaccacgccttcagcgactac

SEQ ID NO: 1532 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctcccctaggcctctctactgggcctgccagggctgcgtcctaaccggcgtctgggtcatagcccacgagtgcggccaccacgccttcagcgactac

SEQ ID NO: 1533 - DNA, 381 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgctccaaacgctccatcccacgctccttctcctacctcctcttcgacatcctcgtctcctcctccctctaccacctctccacagcctacttccctctcctcccccaccctctcccttccctcgctcgccgcagccgaacgaccgagcgcagcgtggcccctctactgggcctgccaaggctgcgtcctaacgggcctctgggtcatcgcccacgaatgcggccaccacgccttcagcgactac

SEQ ID NO: 1534 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcgtctcctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 1535 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccagaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctttcccctggcccctctactgggcctgccaaggctgcgtcctaacgggcctctgggtcatcgcccacgagtgcggccaccacgccttcagcgactac

SEQ ID NO: 1536 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctcgcctctactgggcctgccaaggctgcgtcctaacgggcctctgggtcatcgcccacgaatgcggccaccacgccttcagcgactac

SEQ ID NO: 1537 - DNA, 339 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcctcgtctcctcctccctctaccacctctccacagcctacttccctctcctcccccaccctcccccgtccctcccctctactgggcctgccaaggctgcgtcctaacgggcctctgggtcatcgcccacgaatgcggccaccacgccttcagcgactac

SEQ ID NO: 1538 - DNA, 343 bp, Artificial
  Mutation in BnaC.FAD2.b introduced by TALE nuclease pair BnFAD2_T01
caggatccatgggtgcaggcggaagaatgcaagtgtccccttcctccaaaaagtctgaaaccgacaccatcaagcgcgtaccctgcgagacaccgcccttcactgtcggagaactcaagaaagcaatcccaccgcactgcttcaaacgctccatccctcgctccttctcctacctcctcttcgacatcctcgtctcctcctccctctaccacctctccacagcctacttccctctcctcccccaccctcccccttacccctctactgggcctgccgaggctgcgtcctaacgggcctctgggtcatggcccacgagtgcggccaccacgccatcatcgactac

SEQ ID NO: 1539 - DNA, 335 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttacctcggcccctctactgggcctgccaaggctgcgtcctaacgggcctctgggtcatcgcccacgaatgcggccaccacgccttcagcgactac

SEQ ID NO: 1540 - DNA, 299 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctcttcgacatcatcatctcctcctcggctcctccctcaccctctctcctactgggcctgccaagggtgcgtcctaaccggcgtctgggtcatagcccacgagtgcggccaccacgccttcagcgactac

SEQ ID NO: 1541 - DNA, 336 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccccctcccttacctgggcctgccaaggctgcgtcctaacgggcctctgggtcatagcccacgagtgcggccaccacgccttcagcgactac

SEQ ID NO: 1542 - DNA, 323 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacttcctcgtctccccctccctctcccacttccccacagcctacttcgcctggcctctctactgggcctgccaagggtgcgtcctaaccggcgtctgggtcatagcccacgagtgcggccaccacgccttcagcgactac

SEQ ID NO: 1543 - DNA, 356 bp, Artificial
  Mutation in BnaC.FAD2.b introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgccgcctggcctctctactgggcctgcaagggctgcgtcctaaccggcgtctgggtcatagcccacgagtgcggccaccacgccttcagcgactac

SEQ ID NO: 1544 - DNA, 340 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccccctccctccctctactgggcctgccaaggctgcgtcctaacgggcctcggggtcatcgcccacgaatgcggccaccacgcctttagccactac

SEQ ID NO: 1545 - DNA, 331 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccctggcccctctactgggcctgccaaggctgcgtcctaacgggcctctgggtcatcgtccacgaatgcggccaccacgccttcagcgactac

SEQ ID NO: 1546 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctcggggtcatcgcccacgaatgcggccaccacgccttcagcgactac

SEQ ID NO: 1547 - DNA, 350 bp, Artificial
  Mutation in BnaC.FAD2.b introduced by TALE nuclease pair BnFAD2_T01
caggatccatgggtgcaggtggaagaatgcaagtctcacctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacggcctacttccctctcctccccccccctctcccttacctctagcccctctactgggcctgccaaggctgcttccgaacgggcctcggggtcatagcccgcaagtgcggccaccgcgccatcagcaactac

SEQ ID NO: 1548 - DNA, 314 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctcaccctctctcctacttctggcctctctactgggcctgccagggctgcgtcctaacgggcctctgggtcatagcccacgtttgcggccaccacgccttcagcgactac

SEQ ID NO: 1549 - DNA, 350 bp, Artificial
  Mutation in BnaC.FAD2.b introduced by TALE nuclease pair BnFAD2_T01
caggatccatgggtgcaggtggaagaatgcaagtctctcctccctccagctccccctaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctccccccccaccctctcccttaccacgggcccctctactgggcctgccaaggctgcgtcctaacgggcctcggggtcatcgcccacgaatgcggccaccacgccttcagcgactac

SEQ ID NO: 1550 - DNA, 350 bp, Artificial
  Mutation in BnaC.FAD2.b introduced by TALE nuclease pair BnFAD2_T01
caggatccatgggtgcaggtggacgaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctcacctctggcccctctactgggcctgccaaggctgcgtcctaacgggcctctgtgtcatcgcccacgaatgcggccaccacgccgtcagcgactac

SEQ ID NO: 1551 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttggcctctctactgggcctgccagggctgcgtcctaaccggcgtctgggtcatagcccacgagtgcggccaccacgccttcagcgactac

SEQ ID NO: 1552 - DNA, 391 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctcccccaccctctccctcacccccccaccctcccccccccccccccccccccccccccctccccccgcccctggcccctctacgggccctgccagggctgcgcccaaccgggcctcggggtcatcgcccaccagtgcgcccaccaccccttcagcaacacc

SEQ ID NO: 1553 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcccctctactgggcctgccaaggctgcgtcctaacgggcctctgggtcatcgcccacgaatgcggccaccacgccttcagcgactac

SEQ ID NO: 1554 - DNA, 347 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaacatcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctcccccttatggcccctctactgggcctgccaaggctgcgtccgaacgggcctctgggtcatcgcccacgaatgcggccaccacgccttcagcgactac

SEQ ID NO: 1555 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctatggcctctctactgggcctgccagggctgcgtcctaaccggcgtctgggtcatagcccacgagtgcggccaccacgccttcagcgactac

SEQ ID NO: 1556 - DNA, 353 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccatctcactgcttcaaacgctccatcccacgctcctgctcctcttcgacatcatcatctcctcctcggcacctccctctcccagctctccacagcctacttccctctcctcccccaccccctcccataccgcgctggcccctctacggggcctgccaagactgcgtcctaacgggcctatgggtcatagcccacgagtgcgggcaccaggccttcagcgactac

SEQ ID NO: 1557 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcacacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtccgaacgggcctctgggtcatcgcccacgaatgcggccaccgcgccatcagcgactac

SEQ ID NO: 1558 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccccctcccttacctcgccctggcccctctactgggcctgccaaggctgcgtcctaacgggcctctgggtcatagcccacgagtgcggccaccacgccttcagcgactac

SEQ ID NO: 1559 - DNA, 261 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctcccacctctccacagcctacttccctctcccttaccacgccttcagcgactac

SEQ ID NO: 1560 - DNA, 418 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttagccgtatttagcccaccacttcaagaaccctgcagcaccgcctacatacctcgctctgctaatcctgttacctggcccctctactgggcctgccaaggctgcgtcctaacgggcctctgggtcatcgcccacgaatgcggccaccacgccttcagcgactac

SEQ ID NO: 1561 - DNA, 346 bp, Artificial
  Mutation in BnaC.FAD2.b introduced by TALE nuclease pair BnFAD2_T01
caggatccatgggtgcaggtggaagaatgcaagtctatcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcccctctactgggcctgccaaggctgcgtcctaacgggcctctgggtcatcgcccacgaatgcggccaccacgccttcagcgactac

SEQ ID NO: 1562 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttaccttggcccctctacggggcctgccaaggctgcgtcctaacgggcctctgggtcatcgcccacgaatgcggccaccacgccttcagcgactac

SEQ ID NO: 1563 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctgggcctgccagggctgcgtcctaaccggcgtctgggtcatagcccacgagtgcggccaccacgccttcagcgactac

SEQ ID NO: 1564 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctcccccttacccctctactgggcctgccaaggctgcgtcctaacgggcctctgggtcatagcccacgagtgcggccaccacgccttcagcgactac

SEQ ID NO: 1565 - DNA, 340 bp, Artificial
  Mutation in BnaC.FAD2.b introduced by TALE nuclease pair BnFAD2_T01
caggatcatgggtgcaggtggaagaatgcaagtctctccaccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 1566 - DNA, 350 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctccctcgccgctggcccctctacggggcctgccaaggctgcgtcctaacgggcctctggggcatcgcccgcgaatgcggccaccacgccttcagcgactac

SEQ ID NO: 1567 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttttggcctctctactgggcctgccaagggtgcgtcctaaccggcgtctgggtcatagcccacgagtgcggccaccacgccttcagcgactac

SEQ ID NO: 1568 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatcccacgctccttctcctacctcctcttcgacatcctcgtctcctcctccctctaccacctctccacagcctacttccctctccccccccaccccctcccttatggcccctctactgggcctgccaaggctgcgtcctaacgggcctctgggtcatcgcccacgaatgcggccaccacgccttcagcgactac

SEQ ID NO: 1569 - DNA, 331 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctctcctacggcctctctactgggcctgccaagggtgcgtcctaaccggcgtctggggcatagcccacgagtgcggccaccacgccttcagcgactac

SEQ ID NO: 1570 - DNA, 341 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccaccctcccccttacctctacggggcctgccaaggctgcgtcctaacgggcctctgggtcatcgcccacgaatgcggccaccacgccttcagcgactac

SEQ ID NO: 1571 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctcaccacccacgtataaaccgtcgatgccctgctgaatattgaactgaaccaggcgactggcctctctactgggcctgccaaggctgcgtcctaacgggcctctgggtcatagcccacgagtgcggccaccacgccttcagcgactac

SEQ ID NO: 1572 - DNA, 356 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctcccttacctcgccacctggcccctctactgggcctgccaaggctgcgtcctaacgggcctctgggtcatcgcccacgaatgcggccaccacgccttcagcgactac

SEQ ID NO: 1573 - DNA, 348 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 1574 - DNA, 341 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccccctcccttacctctactgggcctgccaaggctgcgtcctaacgggcctctgggtcatcgcccacgaaggcggccaccacgccttcagcgactac

SEQ ID NO: 1575 - DNA, 355 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttcccacctgcctggcccctctactgggcctgccaaggctgcgtcctaacgggcctctgggtcatcgcccacgaatgcggccaccacgccttcagcgactac

SEQ ID NO: 1576 - DNA, 341 bp, Artificial
  Mutation in BnaC.FAD2.b introduced by TALE nuclease pair BnFAD2_T01
caggatccatgggtgcaggtggaagaatgcaagtctctcctacctccagctcccccggaaccaacacccccaaacgcgtcccctgcgagacaccaccattcactctcggagacctcaagaaagcaatcccacctcactgcttcaaacgctccatccctcgctccttctcctacctcctcttcgacatcctcgtctcctcctccctctcccacctctccacagcctacttccctctcctcccccaccctcccccttacctctgctgggcctgccaaggctgcgtcctaacgggcctctgggtcatcgcccacgaatgcggccaccacgccttcagcgacgac

SEQ ID NO: 1577 - DNA, 341 bp, Artificial
  Mutation in BnaC.FAD2.b introduced by TALE nuclease pair BnFAD2_T01
caggatccatgggtgcaggtggaagaatgcaagtctctcctacctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccacccgctcccttacctctgctgggcctgccaaggctgcgtcctaacgggcctctgggtcatcgcccacgaatgcggccaccacgccttcagcgactac

SEQ ID NO: 1578 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagccacgatggcggcaagcaggcgctggagcctggcccctctactgggcctgccaaggctgcgtcctaacgggcctctgggtcatcgcccacgaatgcggccaccacgccttcagcgactac

SEQ ID NO: 1579 - DNA, 351 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcatcggctcctccctctaccacctctccacagcctacttccctctcctccctcaccctctctcctacttctcgcctctctactgggcctgccaagcgtgcgtcctaaccgtcttcttggtcataccccacgtgtgcggccaccgcgccttcatcgactac

SEQ ID NO: 1580 - DNA, 340 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctccatcccacgctccttctcctcttcgacatcatcatctcctcctcggctcctccctctaccacctctccacagcctacttccctctcccttacctcgtcgtggcccctctactgggcctgccaaggctgcgtcctaacggtcctctgggtcatcgcccacgaatgcggccaacacgccttcagcgactgc

SEQ ID NO: 1581 - DNA, 338 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatccctcgctccttctcctacctcctcttcgacatcctcgtctcctcctccctctaccacctctccacagcctacttccctctcctcccccaccctctccccctctactgggcctgccaaggctgcgtcctaacgggcctctgggtcatcgcccacgaatgcggccaccacgccttcagcgactac

SEQ ID NO: 1582 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctcttcgacatcatcatctcctcctcggctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 1583 - DNA, 343 bp, Artificial
  Mutation in BnaC.FAD2.b introduced by TALE nuclease pair BnFAD2_T01
caggatccatgggtgcaggtggaagaatgcacgtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatagcctcctgcttctactacgtcgccaccacttacttccctctcctccctcaccctctctcctacttctggcctctctactgggcctgccaaggctgcgtcctaacgggcctctgggtcatagcccacgagtgcggccaccacgcctgcagcgactac

SEQ ID NO: 1584 - DNA, 348 bp, Artificial
  Mutation in BnaC.FAD2.b introduced by TALE nuclease pair BnFAD2_T01
caggatccatgggtgcaggtggaagaatgcaagtctatcctccctccagctcccccggaaacaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcccctctaccgggcctgccaaggctgcgtcctaacgggcctctgggtcatagcccacgagtgcggccaccacgccttcagcgactac

SEQ ID NO: 1585 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgacta

SEQ ID NO: 1586 - DNA, 340 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctccctctactgggcctgccaaggctgcgtcctaaccggcgtctgggtcatcgcccacgaatgcggccaccacgccttcagcgactac

SEQ ID NO: 1587 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctgacccctctactgggcctgccaaggctgcgtcctaacgggcctctgggtcatcgcccacgaatgcggccaccacgccttcagcgactac

SEQ ID NO: 1588 - DNA, 348 bp, Artificial
  Mutation in BnaC.FAD2.b introduced by TALE nuclease pair BnFAD2_T01
caggatccatgggtgcaggtggcagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttggcctctctactgggcctgccagggctgcgtcctaaccggcgtctgggtcatagcccacgagtgcggccaccacgccttcagcgactac

SEQ ID NO: 1589 - DNA, 347 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctgcccctctactgggcctgccaaggctgcgtcctaacgggcctctgggtcatcgcccacgaatgcggccaccacgccttcagcgactac

SEQ ID NO: 1590 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacctctctactgggcctgccaagggtgcgtcctaaccggcgtctgggtcatagcccacgagtgcggccaccacgccttcagcgactac

SEQ ID NO: 1591 - DNA, 350 bp, Artificial
  Mutation in BnaC.FAD2.b introduced by TALE nuclease pair BnFAD2_T01
caggatccatgggtgcaggcggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttgcctctggcccctctacggggcctgccaaggctgcgtcctaacgggcctctggggcatcgcccacgaatgcggccaccgcgcctgcagcgactac

SEQ ID NO: 1592 - DNA, 349 bp, Artificial
  Mutation in BnaC.FAD2.b introduced by TALE nuclease pair BnFAD2_T01
caggatccatgggtgcaggtggaagaatgcaagtatctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccccctaccacctctccacagcctacttccctctcctccccctccctctcccttcccccggcccctctactgggcctgccaaggctgcgtcctaacgggcctctgggtcatcgcccacgaatgcggccaccacgccttcagcgactac

SEQ ID NO: 1593 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttctggcctctctactgggcctgccaagggtgcgtcctaacgggcctctgggtcatcgcccacgaatgcggccaccacgccttcagcgactac

SEQ ID NO: 1594 - DNA, 340 bp, Artificial
  Mutation in BnaC.FAD2.b introduced by TALE nuclease pair BnFAD2_T01
caggatccatgggtgcaggtggaagaatgcaagtctatcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctccctctactgggcctgccaaggctgcgtcctaacgggcctctgggtcatcgcccacgaaggcggccaccacgccttcagcgactac

SEQ ID NO: 1595 - DNA, 422 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccgtacctcgttgccggtgctgtgccaggcctacggcttgaccccggagcaggtggtggccatcgccagcaatattggtgctggcccctctactgggcctgccaaggctgcgtcctaaccggcgtctgggtcatagcccacgagtgcgaccaccacgccttcagcgactac

SEQ ID NO: 1596 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccctctactgggcctgccaaggctgcgtcctaacgggcctctgggtcatcgcccacgaatgcggccaccacgccttcagcgactac

SEQ ID NO: 1597 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctaatggcccctctactgggcctgccaaggctgcgtcctaactggcctctgggtcatcgcccacgaatgcggccaccacgcaatcagcgactac

SEQ ID NO: 1598 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttctggcctctctactgggcctgccagggctgcgtcctaaccggcgtctgggtcatagcccacgagtgcggccaccacgccttcagcgactac

SEQ ID NO: 1599 - DNA, 338 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccccctccctgcttcaaacgctccatccctccctccttctcctacctcctcttcgacatcctcgtctcctcctccctctaccacctctccacagcctacttccctctcctccccccccctccccccctctactgggcctgccaaggctgcgtcctaacgggcctctgggtcatcgcccacgaatgcggccaccacgccttcagcgactac

SEQ ID NO: 1600 - DNA, 261 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctactcccctctcccttaccacgccttcagcgactac

SEQ ID NO: 1601 - DNA, 343 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgtttcaaacgctcgatccctcgctccttctcctacctcctcttcgacatcctcgtctcctcctccctctaccacctctccacagcctacttccctctcctcccccaccctctcccttacccctctactgggcctgccaaggctgcgtcctaacgggcctctgggtcatcgcccacgaatgcggccaccacgccttcagcgactac

SEQ ID NO: 1602 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatacggccaccacgccttcagcgactac

SEQ ID NO: 1603 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccctacctcgccctggcccctctactgggcctgccaaggctgcgtcctaacgggcctctgggtcatcgcccacgaatgcggccaccacgcctgcagtgactac

SEQ ID NO: 1604 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccccagcctacttccctctcctcccccccccccccccttgcctcgcccctctactgggcctgccaaggctgcgtcctaacgggcctctgggtcatcgcccacgaatgcggccaccacgccttcagcgactac

SEQ ID NO: 1605 - DNA, 344 bp, Artificial
  Mutation in BnaC.FAD2.b introduced by TALE nuclease pair BnFAD2_T01
caggatccatgggtgcaggtggaagaatgtaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccccctctccacagcctacttccctctcctcccccaccctctcccttggcccctctactgggccggccaaggctgcgtcctaacgggcctctgggtcatcgcccacgaatgcggccaccacgccttcagcgactac

SEQ ID NO: 1606 - DNA, 412 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccccccctggagccgctccaccgcctgttgccgctcctgtcccaggcccccgccttgaccccggggctggcccctctactgggcctgccaaggctgcgtcctaacgggcctctgggtcatagcccacgagtgcggccaccacgccttcagcgactac

SEQ ID NO: 1607 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctaggcctctctactgggcctgccagggctgcgtcctgaccggcgtcggggtcatagcccacgagtgcggccaccacgccttcagcgactac

SEQ ID NO: 1608 - DNA, 355 bp, Artificial
  Mutation in BnaC.FAD2.b introduced by TALE nuclease pair BnFAD2_T01
aaggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctccttcctcgcccctctactgggcctgccaaggctgcgtcctaacgggcctctgggtcatcgcccacgaatgcggccaccacgccttcagcgactac

SEQ ID NO: 1609 - DNA, 422 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgttgccggtgctgtgccaggcctacggcttgaccccggagcaggtggtggccatcgccagcaatattggtgctggcccctctactgggcctgccaaggctgcgtcctaacgggcctctgggtcatcgcccacgaatgcggccaccacgccttcagcgactac

SEQ ID NO: 1610 - DNA, 348 bp, Artificial
  Mutation in BnaC.FAD2.b introduced by TALE nuclease pair BnFAD2_T01
caggatccatgggtgcaggtggcagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctggcccctctactgggcctgccaaggctgcggcctaacgggcctcggggtcatcgcccacgaatgcggccaccacgccttcagcgactac

SEQ ID NO: 1611 - DNA, 478 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctactcctccctctaccacctctccacagcctacttccctctcctcccccaccctctcccccccccccccccccccccccccctacccccccctcttggcgctgccccccccctgctccggggtcaagccgtgggcctgccacagcaccggggcggcgtgcccgcagtggaggcagtgcatgcatggcgctcgcctggcccctctactgggcctgccaaggctgcgtcctaacgggcctctgggtcatagcccacgaatgcggccaccacgccttcagcgactac

SEQ ID NO: 1612 - DNA, 341 bp, Artificial
  Mutation in BnaC.FAD2.b introduced by TALE nuclease pair BnFAD2_T01
caggatccatgggtgcaggtggcagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctccctctaccacctccccacagcccacttccctctcccccccccccctctccctcacctggcccctctactgggcctgccaaggctgcgtcctaacgggcctctgggtcatcgcccacgaatgcggccaccacgccttcagcgactac

SEQ ID NO: 1613 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccccctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 1614 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttggcctctctactgggcctgccaagggtgcgtcctaaccggcgtctgggtcatagcccacgagtgcggccaccacgccttcagcgactac

SEQ ID NO: 1615 - DNA, 422 bp, Artificial
  Mutation in BnaC.FAD2.b introduced by TALE nuclease pair BnFAD2_T01
caggatccatgggtgcaggtggaagaatgcaagtctctcctcactccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctacagagcccagcgtggagcgaacgacctacgccgaactgagataccgacagcgtgagctatgagaaagcgccacgctatggcccctctactgggcctgccaaggctgcgtcctaacgggcctctggggcatcgcccacgaatgctgccaccacgcctgcatcgactac

SEQ ID NO: 1616 - DNA, 381 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccgcgctcgccgcagccgaaggaccgagcgcagcgtggcccctctacggggcctgccaaggctgcgtcctaacgggcctctgggtcatcgcccgcgaatgctgccaccacgccttcagcgactac

SEQ ID NO: 1617 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttgcctctctactgggcctgccaaggctgcgtcctaacgggcctctgggtcatcgcccacgaatgcggccaccacgccttcagcgactac

SEQ ID NO: 1618 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcacacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacccctctactgggcctgccaaggctgcgtcctaacgggcctctgggtcatcgcccacgaatgcggccaccacgcctgcagcgactac

SEQ ID NO: 1619 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctccggcctctctactgggcctgccaagggtgcgtcctaaccggcgtctgggtcatagcccacgagtgcggccaccacgccttcagcgactac

SEQ ID NO: 1620 - DNA, 387 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactctcggagacctcaagaaagcaatcccacctcactgcttcaaacgctccatccctcgctccttctcctacctcctcttcgacatcctcgtctcctcctccctctaccacccctccacagcctacttccctctcctcccccaccctctctcctacttcgccgccatcgtggctggcgatggccaccacctgctcctggcctctctactgggcctgccaaggctgcgtcctaacgggcctctgggtcatagcccacgagtgcggccaccacgccttcagcgactac

SEQ ID NO: 1621 - DNA, 345 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctaggcctctctactgggcctgccaagggtgcgtcctaaccggcgtctgggtcatagcccacgagtgcggccaccacgccttcagcgactac

SEQ ID NO: 1622 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaaccggcgtctgggtcatagcccacgagtgcggccaccacgccttcagcgactac

SEQ ID NO: 1623 - DNA, 339 bp, Artificial
  Mutation in BnaC.FAD2.b introduced by TALE nuclease pair BnFAD2_T01
caggatccatgggtgcaggtggaagaatgcaagtctctactccctccagctcccccggaaccaacaccctcaaacgcgtcccctgcgagacaccaccattcactctcggagacctcaagaaagcaatcccacctcactgcttcaaacgctccatcccacgctccttctcctcttcgacatcctcatctcctcctccctctaccacctctccacagcctacttccctctcctcccccgccctctcccgtacctcccctctactgggcctgccaaggctgcgtcctaacgtgcctctgggtcatcgcccacgaatgcggccaccacgccttcagcgactac

SEQ ID NO: 1624 - DNA, 346 bp, Artificial
  Mutation in BnaC.FAD2.b introduced by TALE nuclease pair BnFAD2_T01
caggatccatgggtgcaggtggaagaatgcaagtctctactccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcccctctactaggcctgccaaggctgcgtcctaacgggcctctgggtcatcgcccacgaatgcgtccaccacgccatcagcgactac

SEQ ID NO: 1625 - DNA, 384 bp, Artificial
  Mutation in BnaC.FAD2.b introduced by TALE nuclease pair BnFAD2_T01
caggatccatgggtgcaggtggaagaatgcaagtctctcctccctccagctccccctgaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcagcggctgttgccggtgctgtgccaggcccacggcttctctctactcggcctgccaagggtgcgtcctaaccggcgtctgggtcatagcccacgagtgcggccaccacgccttcagcgactac

SEQ ID NO: 1626 - DNA, 422 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgttgccggtgctgtgccaggcctacggcttgaccccggagcaggtggtggccatcgccagcaatattggtgctggcccctctactgggcctgccaaggctgcgtcctaacgggcctctgggtcatcgcccacgaatgcggccaccacgccttcagcgactac

SEQ ID NO: 1627 - DNA, 336 bp, Artificial
  Mutation in BnaC.FAD2.b introduced by TALE nuclease pair BnFAD2_T01
caggatccatgggtgcaggtggaagaatgcaagtctctcctcactccagctcccccggaaccaacaccctcaaacgcgtcccctgcgatacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccacccccccccttacctgggcctgccaaggctgcgtcctaacgggcctctgggtcatcgcccacgaatgcggccaccacgccttcagcgactac

SEQ ID NO: 1628 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctactttggcctctctactgggcctgccaagggtgcgtcctaaccggcgtctgggtcatagcccacgagtgcggccaccacgccttcagcgactac

SEQ ID NO: 1629 - DNA, 331 bp, Artificial
  Mutation in BnaC.FAD2.b introduced by TALE nuclease pair BnFAD2_T01
caggatccatgggtgcaggtggcagaatgcaagtgtctcctccctccaaaaagtccgaaaccgacaacatcaagcgcgtaccctgcgagacaccgcccttcactgtcggagaactcaagaaagcaatcccaccgcactgtttcaaacgctccatccctcgctccttctcctacctcctcttcgacatcctcgtctcctcctccctctaccacctctccacagcctacttccctctcctccctggcccctctactgggcctgccaaggctgcgtcctaacgggcctctgggtcatcgcccacgaatgcggccaccacgccttcagcgactac

SEQ ID NO: 1630 - DNA, 342 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgcttcaaacgctccatccctcgctccttctcctacctcctcttcgacatcctcgtctcctcctccctctaccacctctccacagcctacttccctctcctcccccaccctctcccttaccctctactgggcctgccaaggctgcgtcctaacgggcctctgggtcatagcccacgagtgcggccaccacgccttcagcgactac

SEQ ID NO: 1631 - DNA, 425 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttgccttgcggatttgaacgttgtgaagcaacggcccggggggtggcgggccaccacctgctggggggtcaagccgtgggcctggcccctctactgggcctgccaaggctgcgtcctaacgggcctctgggtcatcgcccacgaatgcggccaccacgccttcagcgactac

SEQ ID NO: 1632 - DNA, 349 bp, Artificial
  Mutation in BnaC.FAD2.b introduced by TALE nuclease pair BnFAD2_T01
caggatccatgggtgcaggtggcagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcctcccccacccactcccttaccttggcccctctactgggcctgccaaggctgcgtcctaacgggcctctgggtcatcgcccgcgaatgcggccaccacgcctgcagcgactac

SEQ ID NO: 1633 - DNA, 314 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctcccccaccctctcccttacctctggcccctctactgggcctgccaaggctgcgtcctaacgggcctctgggtcatcgcccacgaatgcggccaccacgccttcagcgactac

SEQ ID NO: 1634 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgcttcaaacgctccatcccacgctccttctcctacctcctcttcgacatcctcgtctcctcctccctctaccacctctccacagcctacttccctctcctcccccaccctctccctggcccctctactgggcctgccaaggctgcgtcctaacgggcctctgggtcatcgcccacgaatgcggccaccacgccttcagcgactac

SEQ ID NO: 1635 - DNA, 338 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccccccccccctctactgggcctgccaaggctgcgtcctaacgggcctctgggtcatcgcccacgaatgctgccaccacgccttcagcgactac

SEQ ID NO: 1636 - DNA, 341 bp, Artificial
  Mutation in BnaC.FAD2.b introduced by TALE nuclease pair BnFAD2_T01
caggatccagggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagccacgatggcggcaagcaggcgctggagcctggcccctctactgggcctgccaaggctgcgtcctaacgggcctctgggtcatcgcccacgaatgcggccaccacgccttcagcgactac

SEQ ID NO: 1637 - DNA, 349 bp, Artificial
  Mutation in BnaC.FAD2.b introduced by TALE nuclease pair BnFAD2_T01
caggatccatgggtgcaggtggaagaatgcaagtttcttctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 1638 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagccacgatggcggcaagcaggcgctggagcctggcccctctactgggcctgccaaggctgcgtcctaacgggcctctgggtcatcgcccacgaatgcggccaccacgccttcagcgactac

SEQ ID NO: 1639 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctacccactggcccctctactgagccggccaaggctgcgtcctaacgggcctctgggtcatcgcccacgaatgcggccaccacgccatcagcgactac

SEQ ID NO: 1640 - DNA, 338 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatagcctcctgcttctactacgtcgccaccacttacttccctctcctccctcaccctctctcctacgcctctctactgggcctgccagggctgcgtcctaaccggcgtctgggtcatagcccacgagtgcggccaccacgccttcagcgactac

SEQ ID NO: 1641 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttaccttggcccctctactgggcctgccaaggctgcgtcctaacgggcctctgggtcatagcccacgagtgcggccaccacgccttcagcgactac

SEQ ID NO: 1642 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctctactgggcctgccaaggctgcgtcctaacgggcctctgggtcatcgcccacgaatgcggccaccacgccttcagcgactac

SEQ ID NO: 1643 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttggcccctctactgggcctgccaagggtgcgtcctaacgggcctctgggtcatagcccacgagtgcggccaccacgccttcagcgactac

SEQ ID NO: 1644 - DNA, 350 bp, Artificial
  Mutation in BnaC.FAD2.b introduced by TALE nuclease pair BnFAD2_T01
caggatccatgggtgcaggtggaagaatgcaagtctctactcactccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttaccttggcccctctactgggcctgccaaggctgcgtcctaacgggcctctgggtcatcgcacacgaatgcggccaccacgccttcagcgactac

SEQ ID NO: 1645 - DNA, 343 bp, Artificial
  Mutation in BnaC.FAD2.b introduced by TALE nuclease pair BnFAD2_T01
caggatccatgggtgcaggtggaagaatgcaagtctctactccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttctctactgggcctgccagggctgcgtcctaaccggcgtctgggtcatagcccacgagtgcggccaccacgccttcagcgactac

SEQ ID NO: 1646 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgatatcctcgtctcctcctccctctaccacctctccacagcctacttccctctcctcccccaccctctcccttaccccctctactgggcctgccaaggctgcgtcctaacgggcctctgggtcatcgcccacgaatgcggccaccacgccttcagcgactac

SEQ ID NO: 1647 - DNA, 334 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccctccactctcggagacctcaagaaagcaatcccacctcactgcttcaaacgctcgatccctcgctccttctcctacctcatctgatccatcatcatagcctcctgcttctactccgccgccaccacttacttccctctcctccctcaccctctctcctacttcgctgccaagggtgcgtcctaacgggcctctgggtcatcgcccacgaatgcggccaccacgccttcagcgactac

SEQ ID NO: 1648 - DNA, 374 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatcccacgctccttctcctcttcgacatcatcatctcctcctccctctaccacctctccacagcctacttccctctcctcccccaccctctcccttccctcgctcgccgcagccgaacgaccgagcgcagcgtggcccctctactgggcctgccaaggctgcgtcctaacgggcctctgggtcatcgcccacgaatgcggccaccacgccttcagcgactac

SEQ ID NO: 1649 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctctactgggcctgccaagggtgcgtcctaaccggcgtctgggtcatagcccacgagtgcggccaccacgccttcagcgactac

SEQ ID NO: 1650 - DNA, 345 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctggcctctctactgggcctgccaagggtgcgtcctaaccggcgtctgggtcatagcccacgagtgcggccaccacgccttcagcgactac

SEQ ID NO: 1651 - DNA, 332 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctccgggcctgccagggctgcgtcctaaccggcgtctgggtcatagcccacgagtgcggccaccacgccttcagcgactac

SEQ ID NO: 1652 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctccctcgcctggcccctctactgggcctgccaaggctgcgtcctaacgggcctctgggtcatcgcccacgaatgcggccaccacgccttcagcgactac

SEQ ID NO: 1653 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccctgaaaccaaaaccatcaaacgcgtcccctgcgagacaccacccttcactctcggagacctcaagaaagcaatcccacctcactgcttcaaacgctccatccctcgctccttctcctacctcctcttcgacatcctcgtctcctcctccctctactacctctccacatcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 1654 - DNA, 346 bp, Artificial
  Mutation in BnaC.FAD2.b introduced by TALE nuclease pair BnFAD2_T01
caggatccatgggtgcaggtggcagaatgcaagtttatacaccctcccgctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctctactgggcctgccaaggctgcgtcctgacgggcctctgggtcatcgcccgcgaatgcgtcctccacgccttcagcgactac

SEQ ID NO: 1655 - DNA, 341 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaacatcaagcgcgtaccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccacccgcctggcccctctacggggcctgccaaggctgcgtcctaacgggcctctgggtcatcgcccaccagtgcggccaccacgccttcagcgactac

SEQ ID NO: 1656 - DNA, 401 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctcccccttaccttgcctcgggcatccaagcggcaagcgcgttacgccgtgggtcgatgtttgactggcccctctactgggcctgccaaggctgcgtcctaacgggcctctgggtcatcgcccgcgaatgcggccaccacgccttcagcgactac

SEQ ID NO: 1657 - DNA, 373 bp, Artificial
  Mutation in BnaC.FAD2.b introduced by TALE nuclease pair BnFAD2_T01
caggatccatgggtgcaggtggaagaatgcaagtgtctcctacctccaaaaagtctgaaaccgacaacatcaagcgcgtaccctgcgagacaccgcccttcactgtcggagacctcaagaaagcaatcccacctcactgcttcaaacgctccatcccacgctccttctcctcttcgacatcatcatctcctcctcggctcctccctctaccacctctccacagcctacttccctctcctccccccccctcccccttccctctccagcggctgttgccgccatcgtgcccctctactgggcctgccaaggctgcgtcctaacgggcctctgggtcatcgcccacgagtgcggccaccacgccttcagcgactac

SEQ ID NO: 1658 - DNA, 335 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttaccttggcccctctactgggcctgccaaggctgcgtcctaacgggcctctgggtcatcgcccacgaatgcggccaccacgccttcagcgactac

SEQ ID NO: 1659 - DNA, 372 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctccagcggctgttgccgccatcgtgcccctctactgggcctgccaaggctgcgtcctaaccggcgtctgggtcatagcccacgagtgcggccaccacgccttcagcgactac

SEQ ID NO: 1660 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctggcccctctacggggcctgccaaggctgcgtcctaacgggcctctgggtcatcgcccacgaatgcggccaccacgccttcagcgactac

SEQ ID NO: 1661 - DNA, 347 bp, Artificial
  Mutation in BnaC.FAD2.b introduced by TALE nuclease pair BnFAD2_T01
caggatccatgggtgcaggtggcagaatgcaagtgtctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctgcccctctactgggcctgccaaggctgcgtcctaacgggcctctgggtcatcgcccacgaatgcgtccaccacgcctgcagcgactac

SEQ ID NO: 1662 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctcccttccctcggcccctctactgggcctgccaaggctgcgtcctaacgggcctctgggtcatcgcccacgaatgcggccaccacgccttcagcgactac

SEQ ID NO: 1663 - DNA, 348 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatagcccacgagtgcggccaccacgccttcagcgactac

SEQ ID NO: 1664 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccggaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctccgcctggcccctctactgggcctgccaaggctgcgtcctaacgggcctctgggtcatcgcccacgaatgcggccaccacgccttcagcgactac

SEQ ID NO: 1665 - DNA, 338 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctcccccaccctctccctggcccctctactgggcctgccaaggctgcgtcctaacgggcctctgggtcatcgcccacgaatgcggccaccacgccttcagcgactac

SEQ ID NO: 1666 - DNA, 446 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttaccgcgcgctggagacggtgcaggcgctgttgccggtgctgtgccaggcccacggcttgaccccccagcaggtggtggccatcgccagcaatattggtgctggcccctctactgggcctgccaaggctgcgtcctaacgggcctctgggtcatcgcccacgaatgcggccaccacgccttcagcgactac

SEQ ID NO: 1667 - DNA, 429 bp, Artificial
  Mutation in BnaC.FAD2.b introduced by TALE nuclease pair BnFAD2_T01
caggatccatgggtgcaggtggcagaatgcaagtctctcctccctccagctcccccggaaccaacaccatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcctcccgcaccctctcccttacctccccagcggctgttgccggtgctgtgccaggcccgcggctggacccctcagcaggtggtggccatcgccagccacgatggtggcccctctactgggcctgccaaggctgcgtcctaacgggcctctgggtcatagcccgcgagtgcggccaccacgcctgcagcgactac

SEQ ID NO: 1668 - DNA, 356 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgccgcctggcctctctactgggcctgccaagggtgcgtcctaaccggcgtctgggtcatagcccacgagtgcggccaccacgccttcagcgactac

SEQ ID NO: 1669 - DNA, 344 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttggcccctctactgggcctgccaaggctgcgtcctaaccggcgtctgggtcatagcccacgagtgcggccaccacgccttcagcgactac

SEQ ID NO: 1670 - DNA, 349 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 1671 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctactttggcctctctactgggcctgccaagggtgcgtcctaaccggcgtctgggtcatagcccacgagtgcggccaccacgccttcgcgactac

SEQ ID NO: 1672 - DNA, 333 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttacctgcccctctactgggcctgccaaggctgcgtcctaaccggcgtctgggtcatatcccacgagtgcggccaccacgccagcagcgactac

SEQ ID NO: 1673 - DNA, 343 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgtccttcactgtcggagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacccctctactgggcctgccaaggctgcgtcctaacgggcctctgggtcatcgcccacgaatgcggccaccacgccttcagcgactac

SEQ ID NO: 1674 - DNA, 346 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttatggcccctctactgggcctgccaaggctgcgtcctaacgggcctctgggtcatcgcccacgaatgcggccaccacgccttcagcgactac

SEQ ID NO: 1675 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcgtctcctcctccctctaccacctctccacagccacgatggcggcaagcaggcgctggagcctggcccctctactgggcctgccaaggctgcgtcctaacgggcctctgggtcatcgcccacgagtgcggccaccacgccttcagcgactac

SEQ ID NO: 1676 - DNA, 333 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcgccctctctcctggacctgccaagggtgcgtcctaaccggcgtctgggtcatagcccacgagtgcggccaccacgccttcagcgactac

SEQ ID NO: 1677 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttggcccctctactgggcctgccaaggctgcgtcctaacgggcctctgggtcatcgcccacgaatgcggccaccacgccttcagcgactac

SEQ ID NO: 1678 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctcccccaccctctcccttacctcgccgtggcccctctactgggcctgccaaggctgcgtcctaacgggcctctgggtcatcgcccacgagtgcgtccaccacgccttcagcgactac

SEQ ID NO: 1679 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctctggcccctctactgggcctgccaaggctgcgtcctaacgggcctctgggtcatagcccacgagtgcggccaccacgccttcagcgactac

SEQ ID NO: 1680 - DNA, 348 bp, Artificial
  Mutation in BnaC.FAD2.b introduced by TALE nuclease pair BnFAD2_T01
caggatccatgggtgcaggtggcagaatgcaagtgtctcctccctccaaaaagtctgaaaccgacaccatcaagcgcgtaccctgcgagacaccgcccttcactgtcggagaactcaagaaagcaatcccaccgcactgcttcaaacgctccatccctcgctccttctcctacctcctcttcgacatcctcgtctcctcctccctctaccacctctccacagcctacttccctctcctcccccaccctctcccttacctggcccctctactgggccggccaaggctgcggccgaacgtgcctctgggtcatcgctcacgaatgcgtccaccacgccaacagcgactac

SEQ ID NO: 1681 - DNA, 356 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcgcctggcccctctactgggcctgccaaggctgcgtcctaacgggcctctgggtcatcgcccacgaatgcggccaccacgccttcagcgactac

SEQ ID NO: 1682 - DNA, 480 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactacttcaaacgctccatccctcgctccttctcctccctcctcttcgacatcctcgtctcctcctccctctaccacctctccacagcctacttccctctcctccccccccctctcccacacccccgcctcctcctccccctccctcccccccaccaccccctccccgcccccccccccccccctcccctactcgccccgcccccctccgggccgttgcttcacaacgttcaaatccgctcccggcggattggcctggcctctctactgggcctgccaaggctgcgtcctaacgggcctctgggtcatatcccgcgagtgcggccaccacgccgtcagcgactac

SEQ ID NO: 1683 - DNA, 348 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttccctggcccctctactgggcctgccaaggctgcgtcctaacgggcctctgggtcatcgcccacgaatgcggccaccacgccttcagcgactac

SEQ ID NO: 1684 - DNA, 320 bp, Artificial
  Mutation in BnaC.FAD2.b introduced by TALE nuclease pair BnFAD2_T01
caggatccatgggtgcaggtggcagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcgactcctccctcaccctctctcctacttcgccgcctggcctctctactgggcctgccaagggtgcgtcctaaccggcgtctgggtcatagcccacgagtgcggccaccacgccatcagcgactac

SEQ ID NO: 1685 - DNA, 351 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacacgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgcggcctctctactgggcctgccagggctgcgtcctaaccggcgtctgggtcatagcccacgagtgcggccaccacgccttcagcgactac

SEQ ID NO: 1686 - DNA, 310 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctcaccctctctcctactggcctctctactgggcctgccaagggtgcgtccgaaccggcgtctgggtcatagctcacgagtgcggccaccacgcctgcagcgactac

SEQ ID NO: 1687 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatagcctcctgcttctactacgtcgccaccacttacttccctctcctccctcaccctctctcctactttggcctctctactgggcctgccaagggtgcgtcctaacgggcctctgggtcatcgcccacgaatgcggccaccacgccttcagcgactac

SEQ ID NO: 1688 - DNA, 331 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccaccattcactctcggagacctcaagaaagcaatcccacctcactgcttcaaacgctccatcccacgctccttctcctcttcgacatcatcatctcctcctccctctaccacctctccacggcctacttccctctcctcccccgccctcgccccctctactgggccggccaaggctgcgtcctaacgggcctctgggtcatcgcccacgaatgcggccaccacgcctgcagcgactac

SEQ ID NO: 1689 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctctggcctctctactgggcctgccagggctgcgtcctaaccggcgtctgggtcatagcccacgagtgcggccaccacgccttcagcgactac

SEQ ID NO: 1690 - DNA, 350 bp, Artificial
  Mutation in BnaC.FAD2.b introduced by TALE nuclease pair BnFAD2_T01
caggatccatgggtgcaggtggacgaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctccccctccctctcccttccccctggcccctctactgggcctgccaaggctgcgtcctaacgggcctctgggtcatagcccacgagtgctgccaccacgccttcagcgactac

SEQ ID NO: 1691 - DNA, 355 bp, Artificial
  Mutation in BnaC.FAD2.b introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgccctggcccctctactgggcctgccaaggctgcgtcctaacgggcctctgggtcatcgcccacgaaggcggccaccacgccttcagcgactac

SEQ ID NO: 1692 - DNA, 340 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctccctctactgggcctgccaagggtgcgtcctaaccggcgtctgggtcatagcccacgagtgcggccaccacgccttcagcgactac

SEQ ID NO: 1693 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctatggcctctctactgggcctgccagggctgcgtcctaaccggcgtctgggtcatagcccacgagtgcggccaccacgccttcagcgactac

SEQ ID NO: 1694 - DNA, 261 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcattatctcctcctcggctcctccctctaccacctctccacagcctacttccctctcccttaccacgccttcagcgactac

SEQ ID NO: 1695 - DNA, 341 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttccctctactgggcctgccaaggctgcgtcctaacgggcctctgggtcatcgcccacgaatgcggccaccacgccttcagcgactac

SEQ ID NO: 1696 - DNA, 340 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttacctcgccctggcccctctactgggcctgccaaggctgcgtcctaacgggcctctgggtcatcgcccacgaatgcggccaccacggcctcagcgactac

SEQ ID NO: 1697 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccccccccctctccctccctctactgggcctgccaaggctgcgtcctaacgggcctctgggtcatcgcccacaaatgcggccaccacgccttcagcgactac

SEQ ID NO: 1698 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccactggcccctctactgggcctgccaaggcttcgtcctaacgggcctctgggtcatcgcccacgaatgcggccaccacgccttcagcgactac

SEQ ID NO: 1699 - DNA, 334 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttacctcgcccctctactgggcctgccaaggctgcgtcctaacgggcctctgggtcatcgcccacgaatgcggccaccacgccttcagcgactac

SEQ ID NO: 1700 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctgccctctactgggcctgccaaggctgcgtcctaaccggcgtctgggtcatagcccacgagtgcggccaccacgccttcagcgactac

SEQ ID NO: 1701 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggcgacctcaagaaagcaatcccccctcactgcttcaaacgctccatccctcgctccttctcctacctcctcttcgacatcctcgtctcctcctccctctaccacctctccacagcctacttccctctcctcccccaccctctcccttacctcgccctggcccctctactgggcctgccaaggctgcgtcctaacgggcctctgggtcatcgcccacgaatgcggccaccacgccttcagcgactac

SEQ ID NO: 1702 - DNA, 312 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctgggtctgccaaggctgcgtcctaacgggcctctgggtcatcgcccacgaatgcggccaccacgccttcagcgactac

SEQ ID NO: 1703 - DNA, 348 bp, Artificial
  Mutation in BnaC.FAD2.b introduced by TALE nuclease pair BnFAD2_T01
caggatccatgggtgcaggtggaagaatgcaagtctctcctcctccagctcccccgaaaccaaaaccctcaaacgcgtcccctgcgagacaccacccttcactctcggagacctcaagatagcaatcccacctcactgcttcaaacgctccatccctcgctccttctcctacctcctcttcgacatcctcgtctcctcctccctctaccacctctccacagcctacttccctctcctcccccaccctctcccttcccttggcccctctactgggcctgccaaggctgcgtcctaacgggcctctgggtcatcgcccacgaatgcggccaccacgccttcagcgactac

SEQ ID NO: 1704 - DNA, 449 bp, Artificial
  Mutation in BnaC.FAD2.b introduced by TALE nuclease pair BnFAD2_T01
caggatccatgggtgcaggtggaagaatgcaagtctctcctccctccagctaccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacgtcgccaggcccacggcttgaccccccagcaggtggtggccatcgccagcaatggcggtggcaagcaggcgctggagacggtccagcggctgttgccggtgctggcctctctactgggcctgccaagggtgcgtcctaaccggcgtctgggtcatagcccacgagtgcggccaccacgccttcagcgactac

SEQ ID NO: 1705 - DNA, 349 bp, Artificial
  Mutation in BnaC.FAD2.b introduced by TALE nuclease pair BnFAD2_T01
caggatccatgggtgcaggtggcagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcggcccctctactgggcctgccaaggctgcgtcctaacgggcctctgggtcatcgcccacgagtgcggccaccacgccttcagcgactac

SEQ ID NO: 1706 - DNA, 261 bp, Artificial
  Mutation in BnaC.FAD2.b introduced by TALE nuclease pair BnFAD2_T01
caggatccatgggtgcaggtggaagaatgcaagtctcgcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttaccacgccttcagcgactac

SEQ ID NO: 1707 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctctttctcctacctcatctgggacatcatcatagcctcctgcttctactacgtcgccaccacttacttccctctcctcccccaccctctcccttcccttggcccctctactgggcctgccaaggcggcgtcctaacgggcctctgggtcatagcccacgagtgcggccaccacgccttcagcgactac

SEQ ID NO: 1708 - DNA, 374 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttccctctcctccccccccctctcccttccctctccagcgcctgcttgccgccatcgtgcccctctactgggcctgccaaggctgcgtcctaacgggcctctgggtcatcgcccacgaatgcggccaccacgccttcagcgactac

SEQ ID NO: 1709 - DNA, 335 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagccacgatggcggcaagcaggcgctggagcctggcctctctactgggcctgccaagggtgcgtcctaaccggcgtctgggtcatagcgcgcgagtgcggccaccacgccatcaacgactac

SEQ ID NO: 1710 - DNA, 344 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacccctctactgggcctgtcaaggctgcgtcctaacgggcctctgggtcatcgcccacgaatgcggccaccacgccttcagcgactac

SEQ ID NO: 1711 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatagcccacgagtgcggccaccacgccttcagctactac

SEQ ID NO: 1712 - DNA, 350 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 1713 - DNA, 316 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctcaccctctctcctaccgccctggcctctctactgggcctgccagggctgcgtcctaaccggcgtctgggtcatagcccacgagtgcggccaccacgccttcagcgactac

SEQ ID NO: 1714 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctacaacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 1715 - DNA, 348 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcctcccccaccctctccctgacctggcccctctactgggcctgccaaggctgcgtcctagcgggcctctgggtcatcgcccacgaatgcggccaccacgcctgcagcgactac

SEQ ID NO: 1716 - DNA, 334 bp, Artificial
  Mutation in BnaC.FAD2.b introduced by TALE nuclease pair BnFAD2_T01
caggatccatgggtgcaggtgcaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctcctcccccaccctctcccttacctcgctggcccctctactgggcctgccaaggctgcgtcctaacgggcctctgggtcatcgcccacgagtgcggccaccacgccttcagcgactac

SEQ ID NO: 1717 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccctggcccctctactgggcctgccaaggctgcgtcctaacgggcctctgggtcatcgcccacgaatgcggccaccacgccttcagcgactac

SEQ ID NO: 1718 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttgcctctctactgggcctgccaagggtgcgtcctaacgggcctctgggtcatagcccacgagtgcggccaccacgccttcagcgactac

SEQ ID NO: 1719 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctaccccctcttcgacatcctcgtctcctcctccctctaccacctctccacagcctacttccctctcctccctcaccctctctcctacttgcctctctactgggcctgccaagggtgcgtcctaaccggcgtctgggtcatagcccacgagtgcggccaccacgccttcagcgactac

SEQ ID NO: 1720 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 1721 - DNA, 336 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttacctctggcccctctactgggcctgccaaggctgcgtcctaacgggcctctgggtcatcgcccacgaatgcggccaccacgccttcagcgactac

SEQ ID NO: 1722 - DNA, 340 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctccttctcctacctcctcttcgacatcctcgtctcctcctccctctaccacctctccacagcctacttccctctcctcccccaccctctctcctactttactgggcctgccagggctgcgtcctaaccggcgtctgggtcatagcccacgagtgcggccaccacgccttcagcgactac

SEQ ID NO: 1723 - DNA, 346 bp, Artificial
  Mutation in BnaC.FAD2.b introduced by TALE nuclease pair BnFAD2_T01
caggatccatgggtgcaggtggaagaatgcaagtgtctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctgccctctactgggcctgccaaggctgcgtcctaacgggcctctgggtcatcgcccacgaatgcggccaccacgccttcagcgactac

SEQ ID NO: 1724 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctccctcctcttcgccatcctcgtctcctcctccccctaccccccctccacagcctacctccctcctccccccctccctctcccttcccttggcccctctactgggcctgccaaggctgcgtcctaacgggcctctgggtcatcgcccacgagtgcggccaccacgccttcagcgactac

SEQ ID NO: 1725 - DNA, 355 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcgactcctccctctaccacctctccacagcctacttccctctcctcccccaccccctccctatccccgccgtggcccctccactgggcctgccgaggctacgtccgaacagacctctgggacatcgcccagaaatgtggccaccacgccatcaacgactac

SEQ ID NO: 1726 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcccacctggcctctctactgggcctgccaagggtgcgtcctaaccggcgtctgggtcatagcccacgagggcggccaccacgccttcagcgactac

SEQ ID NO: 1727 - DNA, 326 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcagacgctccatccctcgctccttctcctacctcctcttcgacatcctcgtctcctcctccctctaccacctctccacagcctacttccctctcctccccctctactgggcctgccaaggctgcgtcctaacgtgcctctgggtcatagcccacgagtgcggccaccacgccttcagcgactac

SEQ ID NO: 1728 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttcccccgctggcccctctactgggcctgccaaggctgcgtcctaacgggcctctgggtcatagcccacgagtgcggccaccacgccttcagcgtctac

SEQ ID NO: 1729 - DNA, 348 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcccctctactgggcctgccaaggctgcgtcctaacgggcctctgggtcatcgcccacgaatgcggccaccacgccttcagcgactac

SEQ ID NO: 1730 - DNA, 334 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctcgcctcccccacccgctcccttgcctctactgggcctgccaaggctgcgtcctaacgggcctctgggtcatcgcccacgaatgcggccaccacgccttcagcgactac

SEQ ID NO: 1731 - DNA, 312 bp, Artificial
  Mutation in BnaC.FAD2.b introduced by TALE nuclease pair BnFAD2_T01
caggatcatgggtgcaggtggaagaatgcaagtgtctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctcaccctctctcctacttcggcctctctactgggcctgccaaggctgcgtcctaacgggcctctgggtcatagcccacgagtgcggccaccacgccttcagcgactac

SEQ ID NO: 1732 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctccccccccctctcccttaccttggcccctctacggggcctgccaaggctgcgtcctaacgggcctctgggtcagcgcccacgaatgcggccaccacgccttcagcgactac

SEQ ID NO: 1733 - DNA, 343 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacctctctactgggcctgccaagggtgcgtcctaaccggcgtctgggtcatagcccacgagtgcggccaccacgccttcagcgactac

SEQ ID NO: 1734 - DNA, 337 bp, Artificial
  Mutation in BnaC.FAD2.b introduced by TALE nuclease pair BnFAD2_T01
caggatccatgggtgcaggtggaagaatgcaagtgtctcctccctccgagaagtctgaaaccgacaccatcaagcgcgtaccctgcgagacaccgcccttcactgtcggagacctcaagaaagcaatcccacctcactgcttcaaacgctccatcccacgctccttctcctcttcgacatcatcatctcctcctcggctcctccctctaccacctctccacagcctacttccctctccccccccccccgctccctcacctgggcctgccaaggctgcgtcctaacgggcctctgggtcatcgcccacgaatgcggccaccacgccttcagcgactac

SEQ ID NO: 1735 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcccctctactgggcctgccaaggctgcgtcctaacgggcctctgggtcatagcccacgagtgcggccaccacgccttcagcgactac

SEQ ID NO: 1736 - DNA, 261 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttacctctcccttaccacgccttcagcgactac

SEQ ID NO: 1737 - DNA, 336 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccccctcccttccctgggcctgccaaggctgcgtcctaacgggcctctgggtcatcgcccacgaatgcggccaccacgccttcagcgactac

SEQ ID NO: 1738 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctacttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 1739 - DNA, 351 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctctggcccctctactgggcctgccaaggctgcgtcctaacgggcgtctgggtcatagcccacgagtgcggccaccacgccttcagcgactac

SEQ ID NO: 1740 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctggcccctctactgggcctgccaaggctgcgtcctaacgggcctctgggtcatcgcccacgaatgcggccaccacgccttcagcgactac

SEQ ID NO: 1741 - DNA, 356 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctcccctccctcaccctctctcctacttcgccgcctggcctctctactgggcctaccagggctgcgtcctaaccggcgtctgggtcatagcccacgagtgcggccaccacgccttcagcgactac

SEQ ID NO: 1742 - DNA, 347 bp, Artificial
  Mutation in BnaC.FAD2.b introduced by TALE nuclease pair BnFAD2_T01
caggatccatgggtgcaggtggaagaatgcaagtgtctccccctccaagaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcccctctactgggcctgccaaggctgcgtcctaaccggcgtctgggtcatagcccacgagggcggccaccacgccttcagcgactac

SEQ ID NO: 1743 - DNA, 355 bp, Artificial
  Mutation in BnaC.FAD2.b introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacctcatcatctcctcctcggctcctccctctaccacctctccacagcctacttccctctccccccccccccccccccttacctcctcccgggcccctctacggggccggccaaggcggcgtcctaacgggcctcggggtcatagcccacgagtgcggccaccacgcctgcagcgactc

SEQ ID NO: 1744 - DNA, 355 bp, Artificial
  Mutation in BnaC.FAD2.b introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttccctccttcctggcccctctactgggcctgccaaggcggcgtcctaacgggcctctgggtcatcgcccacgaatgcggccaccacgccttcagcgactac

SEQ ID NO: 1745 - DNA, 337 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccccctcccctctactgggcctgccaaggctgcgtcctaacgggcctctgggtcatcgcccacgaatgcggccaccacgccttcagcgactac

SEQ ID NO: 1746 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccccgctggcccctctacggggcctgccaaggctgcgtcctaacgggcctctgggtcatcgcccacgaatgcggccaccacgccttcagcgactac

SEQ ID NO: 1747 - DNA, 348 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 1748 - DNA, 336 bp, Artificial
  Mutation in BnaC.FAD2.b introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgcttcaaacgctccatccctcgctccttctcctacctcctcttcgacatcctcgtctcctcctccctctaccacctctccacagcctacttccctctcctcccccaccctctcccttccctgggcctgccatggctgcgtcctaacgggcctctgggtcatagcccacgagtgcggccaccacgccttcagcgactac

SEQ ID NO: 1749 - DNA, 350 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 1750 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccatgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcccctctactgggcctgccaaggctgcgtcctaacgggcctctgggtcatcgcccacgaatgcggccaccacgccttcagcgactac

SEQ ID NO: 1751 - DNA, 349 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttcccttggcccctctactgggcctgccaaggctgcgtcctaacgggcctctgggtcatagcccacgagtgcggccaccacgccttcagcgactac

SEQ ID NO: 1752 - DNA, 350 bp, Artificial
  Mutation in BnaC.FAD2.b introduced by TALE nuclease pair BnFAD2_T01
caggatccatgggtgcaggtcgaagaatgcatgtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctctggcccctctacttggcctgccaaggcttcgtcctaacgggcctctgggtcatcgcccacaaatgcggccaccacgccttcagcgactac

SEQ ID NO: 1753 - DNA, 345 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctccctctactgggcctgccaaggctgcgtcctaacgggcctctgggtcatagcccacgagtgcggccaccacgccttcagcgactac

SEQ ID NO: 1754 - DNA, 373 bp, Artificial
  Mutation in BnaC.FAD2.b introduced by TALE nuclease pair BnFAD2_T01
caggatccatgggtgcaggtggcagaatgcaagtgtctcccccctccaagaagtctgaaaccgacaccatcaagcgcgtaccctgcgagacaccgcccttcactgtcggagacctcaagaaagcaatcccacctcactgcttcaaacgctccatccctcgctccttctcctacctcctcttcgacatcctcgtctcctcctcccgctaccacctctccacagcctacttccctcccctcccccacccgctccctagcgtctccagcgcctgcttgccggcagcgtgcccctctactgggcctgccaaggctgcggcctaacgggcctctgggtcatcgcccacgaatgcggccaccgcgccttcagcgactac

SEQ ID NO: 1755 - DNA, 343 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgcttcaaacgctccatccctcgctccttctcctacctcctcttcgacatcctcgtctcctcctccctctaccacctctccacagcctacttccctctcctcccccaccctcccccttacccctctactgggcctgccaaggctgcgtcctaacgggcctctgggtcatcgcccacgaatgcggccaccacgccttcagcgactac

SEQ ID NO: 1756 - DNA, 329 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctactgccaagggtgcgtcctaaccggcgtctgggtcatagcccacgagtgcggccaccacgccttcagcgactac

SEQ ID NO: 1757 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccatcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctactttggcctctctactgggcctgccagggctgcgtcctaaccggcgtcggggtcatagcccacgagtgcggccaccacgccttcagcgactac

SEQ ID NO: 1758 - DNA, 349 bp, Artificial
  Mutation in BnaC.FAD2.b introduced by TALE nuclease pair BnFAD2_T01
caggatccatgggtgcaggtggaagaatgcaagtctcacctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcggccaccacgcctgcagcgactac

SEQ ID NO: 1759 - DNA, 341 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctggcccctctactgggcctgccaaggctgcgtcctaaccggcgtctgggtcatagcccacgagtgcggccaccacgccttcagcgactac

SEQ ID NO: 1760 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcccaacgggcctctgggtcatagcccacgagtgcggccaccacgccttcagcgactac

SEQ ID NO: 1761 - DNA, 336 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctgggcctgccagggctgcgtcctaaccggcgtctgggtcatagcccacgagtgcggccaccacgccttcagcgactac

SEQ ID NO: 1762 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccagggctgcgtcctaacgggcctctgggtcatcgcccacgaatgcggccaccacgccttcagcgactac

SEQ ID NO: 1763 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctactttggcctctctactgggcctgccaagggtgcgtcctaacgggcctctgggtcatagcccacgagtgcggccaccacgccttcagcgactac

SEQ ID NO: 1764 - DNA, 333 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcgtagacctcaagaaagcaatcccacctcactgcttcaaacgctccatcccacgctccttctcctcttcgacatcatcatctcctcctcggctcctccctctaccacctctccacagcctacttccctctcctccctcaccctctctcctggaactgccaagggtgcgtcctaaccggcgtctgggtcatagcccacgagtgcggccaccacgccttcagcgactac

SEQ ID NO: 1765 - DNA, 355 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctccttcctggcccctctactgggcctgccaaggctgcgtcctaacgggcctctgggtcatcgcccacgaatgcggccaccacgccttcagcgactac

SEQ ID NO: 1766 - DNA, 350 bp, Artificial
  Mutation in BnaC.FAD2.b introduced by TALE nuclease pair BnFAD2_T01
caggatccatgggtgcaggtggcagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttgcctctggcccctctactgggcctgccaaggctgcgtcctaacgggcctctgggtcatagcccacgagtgcggccaccacgccttcagcgactac

SEQ ID NO: 1767 - DNA, 324 bp, Artificial
  Mutation in BnaC.FAD2.b introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcgccaagggtgcgtcctaaccggcgtctgggtcatagcccacgagtgcggccaccacgccttcagcgactac

SEQ ID NO: 1768 - DNA, 320 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctcaccctctctcctacttcgccgcctggcctctctactgggcctgccaagggtgcgtcctaaccggcgtctgggtcatagcccacgagggcggccaccacgccttcagcgactac

SEQ ID NO: 1769 - DNA, 341 bp, Artificial
  Mutation in BnaC.FAD2.b introduced by TALE nuclease pair BnFAD2_T01
caggatccatgggtgcaggtggcagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctggcccctctacggggcttgccaaggctgcgtcctaacgggcctctggggcatcgcccacaaatggggccaggacggcttcagcgactac

SEQ ID NO: 1770 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcgtctgggtcatagcccacgagtgcggccaccacgccttcagcgactac

SEQ ID NO: 1771 - DNA, 342 bp, Artificial
  Mutation in BnaC.FAD2.b introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccaccgcactgcttcaaacgctccatccctcgctccttctcctacctcctcttcgacatcctcgtctcctcctccctctaccacctctccacagccacgatggcggcaagcaggcgctggagcctggcccctctactgggcctgccaaggctgcgtcctaaccggcgtctgggtcatagcccacgagtgcggccaccacgccttcagcgactac

SEQ ID NO: 1772 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagccacgatggcggcaagcaggcgctggagcctggcccctctactgggcctgccaaggctgcgtcctaacgggcctctgggtcatcgcccacgaatgcggccaccacgtcttcagcgactac

SEQ ID NO: 1773 - DNA, 395 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctcccccttccccctaggggccagccccggcgcagattatttggattgagactgaatatggcccctctactgggcctgccaagggtgcgtcctaaccggcgtctgggtcatagcccacgagtgcggccaccacgccttcagcgactac

SEQ ID NO: 1774 - DNA, 261 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttaccacgccttgagcgactac

SEQ ID NO: 1775 - DNA, 338 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctcgccccctctactgggcctgccaaggctgcgtcctaacgggcctctgggtcatcgcccacgaatgcggccaccacgccttcagcgactac

SEQ ID NO: 1776 - DNA, 351 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccatcaaacgagtcccctgcgagccaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttcccgctggcccctctactgggcctgccaaggctgcgtcctaacgggcctctgggtcatagcccacgagtgcgtccaccacgccttcagcgactac

SEQ ID NO: 1777 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccaactctccacagcctacttccctctcctcccccaccctctcccttacccctggcccctctactgggcctgccaaggctgcgtcctaacgggcctctgggtcatcgcccacgaatgcggccaccacgccttcagcgactac

SEQ ID NO: 1778 - DNA, 416 bp, Artificial
  Mutation in BnaC.FAD2.b introduced by TALE nuclease pair BnFAD2_T01
caggatccatggtgcaggtggaagaatgcaagtgtctcctccctccaagaagtctgaaaccgacaccatcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgtcaggacatgatcgcagcgttgccagagcgagattctccgcgctgtagaagtcaccattgttgtgctggcctctctactgggcctgccagggctgcgtcctaaccggcgtctgggtcatagcccacgagtgcggccaccacgccttcagcgactac

SEQ ID NO: 1779 - DNA, 394 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgggggcggatttgaacgttgtgaagcaacggcccggagggtggcgggcgtctctactgggcctgccaaggctgcgtcctaacgggcctctgggtcatcgcccacgaatgcggccaccacgccttcagcgactac

SEQ ID NO: 1780 - DNA, 336 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctcccccaccctctcccttacccctctactgggcctgccaaggctgcgtcctaacgggcctctgggtcatcgcccacgaatgcggccaccacgccttcagcgactac

SEQ ID NO: 1781 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctactgggcctgccaaggctgcgtcctaacgggcctctgggtcatcgtccacgaatgcggccaccacgccttcagcgactac

SEQ ID NO: 1782 - DNA, 394 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgggagcggatttgaacgttgtgaagcaacggcccggagggtggcgggcgtctctactgggcctgccaaggctgcgtcctaacgggcctctgggtcatagcccacgagtgcggccaccacgccttcagcgactac

SEQ ID NO: 1783 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaacccaaacccctcaaacgcgtcccctgcgagaccccccccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctggcccctctactgggcctgccaaggctgcgtcctaacgggcctctgggtcatcgcccacgagtgcggccaccacgccttcagcgactac

SEQ ID NO: 1784 - DNA, 318 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctcaccctctctcctactttcgcctggcctctctactgggcctgccaagggtgcgtcctaaccggcgtctgggtcatagcccacgagtgcggccaccacgccttcagcgactac

SEQ ID NO: 1785 - DNA, 342 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactctcggagacctcaagaaagcaatcccacctcactgcttcaaacgctccatcccacgctccttctcctcttcgacatcatcatctcctcctcggctcctccctctaccacctctccacagcctacttccctctcctcccccaccccctcccttacctctactgggcctgccaaggctgcgtcctaacgggcctctgggtcatagcccacgagtgcggccaccacgccttcagcaactac

SEQ ID NO: 1786 - DNA, 339 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctctctactgggcctgccaagggtgcgtcctaacgggcctcttggtcatcgcccacgaatgcggccaccacgccttcagcgactac

SEQ ID NO: 1787 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttccctgccctctactgggcctgccaaggctgcgtcctaacgtgcctctgggtcatcgcccacgaatgcggccaccacgccttcagcgactac

SEQ ID NO: 1788 - DNA, 331 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctcctcccccaccctctcccttaccttggcccctctactgggcctgccaaggctgcgtcctaacgggcctctgggtcatcgcccacgaatgcggccaccacgccttcagcgactac

SEQ ID NO: 1789 - DNA, 354 bp, Artificial
  Mutation in BnaC.FAD2.b introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctccgcctggcccctctactgggcctgccaaggctgcgtcctaacgggcctctgggtcatcgcccacgagtgcggccaccacgccttcagcgactac

SEQ ID NO: 1790 - DNA, 338 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctccccctctactgggcctgccaaggctgcgtcctaacgggcctctgggtcatagcccacgagtgcggccaccacgccttcagcgactac

SEQ ID NO: 1791 - DNA, 326 bp, Artificial
  Mutation in BnaC.FAD2.b introduced by TALE nuclease pair BnFAD2_T01
caggatccatgggtgcaggtggaagaatgcaagtctatcctccctccagctcccccggaaccaacaccctcaaacccgtcccctgcgagacaccaccattcactctcggagacctcaagaaagcaatcccacctcactgcttcaaacgctccatccctcgctccttctcctacctcctcttcgacatcctcgtctcctcctccctctacaacctctccacagcctacttccctctcctccccctctactgggcctgccaaggctgcgtcctaacgggcctctgggtcatagcccacgagttcggccaccacgccttcagcaactac

SEQ ID NO: 1792 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaataccacctcactgcttcaaacgctccatccctcgctccttctcctacctcctcttcgacatcctcgtctcctcctccctctaccacctctccacagcctacttccctctcctcccccaccctctcccttacctcgcctggccctctactgggcctgccaaggctgcgtcctaacgggcctctgggtcatcgcccacgaattcggccaccacgccttcagcgactac

SEQ ID NO: 1793 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccctctactgggcctgccaaggctgcgtcctaacgggcctctgggtcatcgcccaccaatgcggccaccacgccttcagcgactac

SEQ ID NO: 1794 - DNA, 355 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttccctccgcctggcccctctactgggcctgccaaggctgcggcctaacgggcctctgggtcatcgcccacgaatgcggccaccacgccttgagcgactac

SEQ ID NO: 1795 - DNA, 352 bp, Artificial
  Mutation in BnaC.FAD2.b introduced by TALE nuclease pair BnFAD2_T01
caggatccatgggtgcaggtggcagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggccctctactgggcctgccaaggctgcgtcctaacgggcctctgggtcatcgcccacgaatgcggccaccacgccttcagcgactac

SEQ ID NO: 1796 - DNA, 348 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 1797 - DNA, 261 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgctacaaacgctccatcccacgctccttctcctcttcgacatcatcatctcctcctcggctcctccctctaccacctctccacagcctacttccctctcccttaccacgccttcagcgactac

SEQ ID NO: 1798 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacctctctactgggcctgccagggctgcgtcctaaccggcgtctgggtcatagcccacgagtgcggccaccacgccttcagcgactac

SEQ ID NO: 1799 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttatggcccctctactgggcctgccaaggctgcgtcctaacgggcctctgggtcatcgcccacgagtgcggccaccacgccttcagcgactac

SEQ ID NO: 1800 - DNA, 387 bp, Artificial
  Mutation in BnaC.FAD2.b introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggggacctcaagaaagcaatcccaccgcactgcttcaaacgctccatcccacgctccttctcctacctcctcttcgacatcctcgtctcctcctccctctaccacctctccacagcctacttccctctcctccctcaccctctctcctacttcgccgccatcgtggctggcgatggccaccacctgctcctggcctctctactgggcctgccaagggtgcgtcctaaccggcgtctgggtcatagcccacgagtgcggccaccacgccttcagcgactac

SEQ ID NO: 1801 - DNA, 261 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctcattctcctcttcgacatcatcatctcctcctcggctcctccctctaccacctctccacagcctacttccatctcccttaccacgccttcagcgactac

SEQ ID NO: 1802 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttcccgtggcccctctactgggcctgccaaggctgcgtcctaacgggcctctgggtcatcgcccacgaaggcggccaccacgccttcagcgactac

SEQ ID NO: 1803 - DNA, 348 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatcgcccacgaattcggccaccacgccttcagcgactac

SEQ ID NO: 1804 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctccccccccaccctctcccttccctcccctctactgggcctgccaaggctgcgtcctaacgggcctctgggtcatagcccacgagtgcggccaccacgccttcagcgactac

SEQ ID NO: 1805 - DNA, 347 bp, Artificial
  Mutation in BnaC.FAD2.b introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctatggcctctctactgggcctgccaaggctgcgtcctaacgggcctctgggtcagagcccacgagggcggccaccacgccttcagcgactac

SEQ ID NO: 1806 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaattccacctcactgcttcaaacgctccatccctcgctccttctcctacctcctcttcgacatcctcgtctcctcctccctctaccacctctccacagcctacttccctctcctcccccaccctctcccttccctcgcccctctactgggcctgccaaggctgcgtcctaacgggcctctgggtcatcgcccacgaatgcggccaccacgccttcagcgactac

SEQ ID NO: 1807 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctctactgggcctgccaaggctgcgtcctaacgggcctctgggtcatcgcccacgaatgcggccaccacgccttcagcgactac

SEQ ID NO: 1808 - DNA, 455 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttcccgcgcctgctggcgatggcccccacctgctccggggtcaagccgtgggcctggcacagccccggggcggcgtgaccgcagtggaggcagtgcatgcagggcgctcgcctggcccctctactgggcctgccaaggctgcgtcctaacgggcctctgggtcatagcccacgagtgcggccaccacgccttcagcgactac

SEQ ID NO: 1809 - DNA, 350 bp, Artificial
  Mutation in BnaC.FAD2.b introduced by TALE nuclease pair BnFAD2_T01
caggatccatgggtgcaggtggaagaatgcaagtgtctcctccctccagaaagtctgaaaccgacaccatcaagcgcgtaccctgcgagacaccgcccttcactgtcggagacctcaagaaagcaatcccacctcactgcttcaaacgctccatccctcgctccttctcctacctcctcttcgacatcctcgtctcctcctccctctaccacctctccacagcctacttccctctcccccccccccctccccccctcccctggcccctctactgggcctgccaaggctgcgtcctaacgggcctctgggtcatcgcccacgaatgcggccaccacgccttcagcgactac

SEQ ID NO: 1810 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttccctctggcccctctactgggcctgccaaggctgcgtcctaacgggcctctgggtcatagcccacgagtgcggccaccacgccttcaggactac

SEQ ID NO: 1811 - DNA, 352 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctccccccccctctcccttaccccgccggcccctctactgggcctgccaaggctgcgtcctaacgggcctctgggtcatcgcccacgaatgcggccaccacgccttcagcgactac

SEQ ID NO: 1812 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccccctaccacctctccacagcctacttccctctcctcccccaccctctcccttacctccgcctggcccctctacggggcctgccaaggctgcgtcctaacgggcctctgggtcatcgcccacgaatgtggccaccacgccttcagcgactac

SEQ ID NO: 1813 - DNA, 423 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctcccccttacctcgttgccggtgctctgccaggcccacggcttgaccccggggcaggtggtggccatcgccagcaatattggtgctggcccctctactgggcctgccaaggctgcgtcctaacgggcctctgggtcatcgcccacgaatgcggccaccacgccttcagcgactac

SEQ ID NO: 1814 - DNA, 355 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcctccctggcccctctactgggcctgccaaggctgcgtcctaacgggcctctgggtcatcgcccacgaatgcggccaccacgccttcagcgactac

SEQ ID NO: 1815 - DNA, 331 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctcctcccccaccctctcccttaccttggcccctctactgggcctgccaaggctgcgtcccaacgggcctctgggtcatcgcccacgaatgcggccaccacgccttcagcgactac

SEQ ID NO: 1816 - DNA, 337 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctcgcccctctactgggcctgccaaggctgcgtcctaacgggcctcggggtcatcgcccacgaatgcggccaccacgccttcagcgactac

SEQ ID NO: 1817 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctccctccccgcccctctactgggcctgccaaggctgcgtcctaacgggcctctgggtcatagcccacgaatgcggccaccacgccttcagcgactac

SEQ ID NO: 1818 - DNA, 337 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctccctcaccctctctcctagcctctctactgggcctgccagggctgcgtcctaacgggcctctgggtcatcgcccacgaatgcggccaccacgccttcagcgactac

SEQ ID NO: 1819 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacacgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttatggcccctctactgggcctgccaaggctgcgtcctaacgggcctctgggtcatcgcccacgaatgcggccaccacgccttcacgacta

SEQ ID NO: 1820 - DNA, 343 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccaccattcactctcggagacctcaagaaagcaatcccacctcactgcttcaaacgctccatccctcgctccttctcctacctcctattcgacatcctcgtctcctcctccctctaccacctctccacagcctacttccctctcctcccccaccctctccctggcccctctactgggcctgccaaggctgcgtcctaacgggcctctgggtcatagcccacgagtgcggccaccacgccttcagcgactac

SEQ ID NO: 1821 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacccctctactgggcctgccaaggctgcgtcctaacgggcctctgggtcatcgcccacgaatgcggccaccacgccttcagcgactac

SEQ ID NO: 1822 - DNA, 312 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctaaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctgggtctgccaaggctgcgtcctaacgggcctctgggtcatcgcccacgaatgcggccaccacgccttcagcgactac

SEQ ID NO: 1823 - DNA, 349 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 1824 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcggcccctctactgggcctgccaaggctgcgtcctaacgggcctctgggtcatcgcccacgaatgcggccaccacgccttcagcgactac

SEQ ID NO: 1825 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatcccacgctccttctcctcttcgacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 1826 - DNA, 349 bp, Artificial
  Mutation in BnaC.FAD2.b introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttggcctctctactgggcctgccaagggtgcgtcctaaccggcgtctgggtcatagcccacgagtgctgccaccacgccttcagcgactac

SEQ ID NO: 1827 - DNA, 468 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttcccttgaggggtcaagccgtgggcctggcacagcaccggcaacagcgccttcaacttttgtatacaaagttgttgcatgcaggcctctgcaggggcaagcacctgggcggctccaggaagccctggcccctctactgggcctgccaaggctgcgtcctaacgggcctctgggtcatagcccacgagtgcggccaccacgccttcagcgactac

SEQ ID NO: 1828 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctacctctaccccctctccaccgcctacttccctctcctccctcaccctctctccgcctggcctctctactgggcctgccagggctgcgtcctaaccggcgtctgggtcatagcccacgagtgcggccaccacgccttcagcgactac

SEQ ID NO: 1829 - DNA, 337 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccaccgcactgcttcaaacgctccatccctcgctccttctcctacctcctcttcgacatcctcgtctcctcctccctctaccacctctccacagcctacttccctctccattacctcgctggcccctctactgggcctgccaaggctgcgtcctaacgggcctctgggtcatagcccacgagtgcggccaccacgccttcagcgactac

SEQ ID NO: 1830 - DNA, 341 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgccattcactgtcggagaactcaagaaagcaatcccaccgcactgtttcaaacgctccatcccacgctccttctcctcttcgacatcctcgtctcctcctccctctaccacctctccacagcctacttccctctcctcccccaccctctcccttacctggcccctctactgggcctgccaaggctgcgtcctaacgggcctctgggtcatagcccacgagtgcggccaccacgccttcagcgactac

SEQ ID NO: 1831 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccggaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccctctactgggcctgccaaggctgcgtcctaacgggcctctgggtcatcgcccacgaatgcggccaccacgccttcagcgactac

SEQ ID NO: 1832 - DNA, 326 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccccctctactgggcctgccaaggctgcgtcctaacgggcctctgggtcatagcccacgagtgcggccaccacgccttcagcgactac

SEQ ID NO: 1833 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctcttcgacatcatcatctcctcctcggctcctccctctaccacctctccacagcctacttccctctcctcccccaccctctcccttacctggcccctctactgggcctgccaaggctgcgtcctaaccggcgtctgggtcatagcccacgagtgcggccaccacgccttcagcgactac

SEQ ID NO: 1834 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccgctggcccctctactgggcctgccaaggctgcgtcctaacgggcctctgggtcatcgcccacgaatgcggccaccacgccttcagcgactac

SEQ ID NO: 1835 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacacactcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttgcctggcccctctacggggcctgccaaggctgcgtcctaacgggcctctgggtcatagcgcacgagtgcggccaccacgccgtcagcgactac

SEQ ID NO: 1836 - DNA, 341 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctctggcccctctactgggcctgccaaggctgcgtcctaactggcctctgggtcatagcccacgagtgcggccaccacgccttcagcgactac

SEQ ID NO: 1837 - DNA, 418 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctccccccccctctcccttagccgtagttaggccaccccttcaagaactctgtagcaccgcctacatacctcgctctgctaatcctgttacctggcccctctactgggcctgccaaggctgcgtcctaacgggcctctgggtcatcgcccacgaatgcggccaccacgccttcagcgactac

SEQ ID NO: 1838 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttcccttggcccctctactgggcctgccaaggctgcgtcctaacgggcctctgggtcatcgcccacgaatgcggccaccacgccttcagcgactac

SEQ ID NO: 1839 - DNA, 312 bp, Artificial
  Mutation in BnaC.FAD2.b introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctcaccctctctcctacttggcctctctactgggcctgccaagggtgcgtcctaaccggcgtctgggtcatagcccacgagtgcggccaccacgccttcagcgactac

SEQ ID NO: 1840 - DNA, 349 bp, Artificial
  Mutation in BnaC.FAD2.b introduced by TALE nuclease pair BnFAD2_T01
caggatccatgggtgcaggtcgaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcggccaccacggcttcagcgactac

SEQ ID NO: 1841 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttcccttggcccctctactgggcctgccaaggctgcgtcctaacgggcctctgggtcatcgcccacgaatgcggccaccacgccgtcagcgactac

SEQ ID NO: 1842 - DNA, 345 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttccctccctctactgggcctgccaaggctgcgtcctaacgggcctctgggtcatcgcccacgaatgcggccaccacgccttcagcgactac

SEQ ID NO: 1843 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttccctggcccctctactgggcctgccaaggctgcgtcctaacgggcctctgggtcatagcccacgagtgcggccaccacgccttcagcgactac

SEQ ID NO: 1844 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcactcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 1845 - DNA, 325 bp, Artificial
  Mutation in BnaC.FAD2.b introduced by TALE nuclease pair BnFAD2_T01
caggatccatggggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttcgcctggcctctctactgggcctgccaaggctgcgtcctaacgggcctctgggtcatagcccacgagtgcggccaccacgccttcagcgactac

SEQ ID NO: 1846 - DNA, 351 bp, Artificial
  Mutation in BnaC.FAD2.b introduced by TALE nuclease pair BnFAD2_T01
caggatccatgggtgcaggtggaagaatgcaagtgtctcctccatccaagaagtctgaaaccgacaccatcaagcgcgtaccctgcgagacaccgcccttcactgtcggagaactcaagaaagcaatcccacctcactgcttcaaacgctccatcccacgctccttctcctcttcgacatcatcatctcctcctcggctcctccctctaccacctctccacagcctacttccctctcctccccccccctctcccttacctctggcccctctactgggcctgccaaggctgcgtcctaacgggcctctgggtcatcgcccacgaatgcggccaccacgccttcagcgactac

SEQ ID NO: 1847 - DNA, 326 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctccccctctactgtgcctgccaaggctgcgtcctaacgggcctctgggtcatcgcccacgaatgcggccaccacgccttcagcgactac

SEQ ID NO: 1848 - DNA, 340 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctccctctactgggcctgccaaggctgcgtcctaacgggcctctgggtcatagcccacgagtgcggccaccacgccttcagcgactac

SEQ ID NO: 1849 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagccacgatggcggcaagcaggcgctggagcctggcccctctacggggcctgccaaggctgcgtcctaacgggcctctgggtcatcgcccacgaatgcggccaccacgccttcagcgactac

SEQ ID NO: 1850 - DNA, 429 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctctccagcggctgttgccggtgctgtgccaggcccacggcttgacccctcagcaggtggtggccatcgccagccacgatggtggcccctctactgggcctgccaaggctgcgtcctaacgggcctctgggtcatcgcccacgaatgcggccaccacgccttcagcgactac

SEQ ID NO: 1851 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgctggcctctctactgggcctgccagggctgcgtcctaaccggcgtctgggtcatagcccacgagtgcggccaccacgccttcagcgactac

SEQ ID NO: 1852 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctactggcctctctactgggcctgccaagggtgcgtcctaaccggcgtctgggtcatagcccacgagtgcggccaccacgccttcagcgactac

SEQ ID NO: 1853 - DNA, 344 bp, Artificial
  Mutation in BnaC.FAD2.b introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacccctctactgggcctgccaaggctgcgtcctaacgggcctctgggtcatcgcccacgaatgcggccaccacgccttcagcgactac

SEQ ID NO: 1854 - DNA, 340 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatcccacgctccttctcctcttcgacatcatcatctcctcctcggctcctccctctaccacctctccacagcctacttccctctcccttacctccgcctggcccctctactgggcctgccaaggctgcgtcctaacgggcctctgggtcatcgcccacgaatgcggccaccacgccttcagcgactac

SEQ ID NO: 1855 - DNA, 351 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttctggcctctctactgggcctgccagggctgcgtcctaaccggcgtctgggtcatagcccacgagtgcggccaccacgccttcagcgactac

SEQ ID NO: 1856 - DNA, 355 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctaaagaaagcaatcccacctcactgcttcaaacgctccatccctcgctccttctcctacctcctcttcgacatcctcgtctcctcctccctctaccacctctccacagcctacttccctctcctcccccaccctctcccttacctccttcctggcccctctactgggcctgccaaggctgcgtcctaacgggcctctgggtcatcgcccacgaatgcggccaccacgccttcagcgactac

SEQ ID NO: 1857 - DNA, 332 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttacctgccctctactgggcctgccaaggctgcgtcctaacgggcctctgggtcatcgcccacgaatgcggccaccacgccttcagcgactac

SEQ ID NO: 1858 - DNA, 354 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgtcgtggcccctctactgggcctgccaaggctgcgtcctaaccggcgtctgggtcatagcccacgagtgcggccaccacgccttcagcgactac

SEQ ID NO: 1859 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaaaaccttcaaccgcgtcccctcggagccaccccccttcactctcgcagaccccaggaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 1860 - DNA, 261 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggatacctcaagaaagcaatccctcctcactgcttcaaacgctccatcccacgctccttctcctcttcgacatcatcatctcctcctcggctcctccctctaccacctctccacagcctacttccctctcccttaccacgccttcagcgactac

SEQ ID NO: 1861 - DNA, 355 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcgcctggcccctctactgggcctgccaaggctgcgtcctaacgggcctctgggtcatcgcccacgaatgcggccaccacgccttcagcgactac

SEQ ID NO: 1862 - DNA, 358 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctacatccctcgctccttctcctacctcctcttcgacatcctcgtctcctcctccctctaccacctctccacagcctacttccctctcctcccccaccctctcccttacctcgcctcgtctggcccctctactgggcctgccaaggctgcgtcctaacgggcctctgggtcatcgcccacgaatgcggccaccacgccttcagcgactac

SEQ ID NO: 1863 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctccttcgcctctctactgggcctgccagggctgcgtcctaaccggcgtctgggtcatagcccacgagtgcggccaccacgccttcagcgactac

SEQ ID NO: 1864 - DNA, 348 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcccctctactgggcctgccaaggctgcgtcctaacgggcctctgggtcatagcccacgagtgcggccaccacgccttcagcgactac

SEQ ID NO: 1865 - DNA, 312 bp, Artificial
  Mutation in BnaC.FAD2.b introduced by TALE nuclease pair BnFAD2_T01
caggattcatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctgggtctgccaaggctgcgtcctaacgggcctctgggtcatcgcccacgaatgcggccaccacgccttcagcgactac

SEQ ID NO: 1866 - DNA, 345 bp, Artificial
  Mutation in BnaC.FAD2.b introduced by TALE nuclease pair BnFAD2_T01
caggatccatgggtgcaggtggaagaatgcaagtctctcctccctccagctccccggaaccaacacccccaaacgcgtcccctgcgagaccccaccattcactctcggagacctcaagaaagcaatcccccctcactgcttcaaacgctccatccctcgctccttctcctacctcctcttcgacatcctcgtctcctcctccccctcccacctccccacagcctacttccctcccctcccccaccccctccattacctcccctctactgggcctgccaaggctgcgtcctaacgggcctctgggtcatcgcccacgaatgcggccaccacgccttcagcgactac

SEQ ID NO: 1867 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccctggcccctctactgggcctgccaaggctgcgtcctaacgggcgtctgggtcatagcccacgagtgcggccaccacgccttcagcgactac

SEQ ID NO: 1868 - DNA, 347 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagacctcaagaaagcaatcccacctcactgcttcaaacgctccatcccacgctccttctcctcttcgacatcatcatctcctcctcggctcctccctctaccacctctccacagcctacttccctctcctccccccccccctccctgatggcccctctactgggcctgccaaggctgcgtcctaacgggcctctgggtcatcgcccacgaatgcggccaccacgccttcagcgactac

SEQ ID NO: 1869 - DNA, 340 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctccctctactgggcctgccaaggctgcgtcctaaccggcgtctgggtcatagcccacgagtgcggccaccacgccttcagcgactac

SEQ ID NO: 1870 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttcccttggcccctctactgggcctgccaaggctgcgtcctaacgggcctctgggtcatcgcccacgaatgcggccaccacgccttcagcgactac

SEQ ID NO: 1871 - DNA, 387 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctcccccaccctctcccttacctcgggagcggatttgaacgttgtgaagcaacggcccggagggtggcgggcgtctctactgggcctgccaaggctgcgtcctaacgggcctctgggtcatcgcccacgaatgcggccaccacgccttcagcgactac

SEQ ID NO: 1872 - DNA, 421 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcaagcaggcgctggagacggtccagcggctgttgccggtgctgtgccaggcccacggcttgacccccctggcccctctactgggcctgccaagggtgcgtcctaaccggcgtctgggtcatagcccacgagtgcggccaccacgccttcagcgactac

SEQ ID NO: 1873 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctccccctggcccctctactgggcctgccaaggctgcgtcctaacgggcctctgggtcatagcccacgagtgcggccaccacgccttcagcgactac

SEQ ID NO: 1874 - DNA, 310 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctcaccctctctcctacttcctctctactgggcctgccaagggtgcgtcctaaccggcgtctgggtcatagcccacgagtgcggccaccacgccttcagcgactac

SEQ ID NO: 1875 - DNA, 356 bp, Artificial
  Mutation in BnaC.FAD2.b introduced by TALE nuclease pair BnFAD2_T01
caggatccatgggtgcaggtggaagaatgcaagtgtctcctccctccaagaagtctgaagccgacaccatcaagcgcgtaccctgcgagacaccgcccttcactgtcggagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgccgcctggcccctctactgggcctgccaaggctgcgtcctaacgggcctctgggtcatcgcccacgaatgcggccaccacgccttcagcgactac

SEQ ID NO: 1876 - DNA, 356 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctactttcctctcctcccccaccctctcccttccctcgccgcctggcccctctactgggcctgccaaggctgcgtcctaacgggcctctgggtcatcgcccacgaatgcggccaccacgccttcagcgactac

SEQ ID NO: 1877 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 1878 - DNA, 351 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccccccccctctcccttacccctggcccctctactgggcctgccaaggctgcgtcctaacgggcctctgggtcatcgcccacgaatgcggccaccacgccttcagcgactac

SEQ ID NO: 1879 - DNA, 351 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctcgcccttacctctggcccctctactgggcctgccaaggctgcgtcctaaccggcgtctgggtcatagcccacgagtgcggccaccacgccttcagcgactac

SEQ ID NO: 1880 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccccgccggcccctctactgggcctgccaaggctgcgtcctaaccggcgtctgggtcatagcccacgagtgcggccaccacgccttcagcgactac

SEQ ID NO: 1881 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctcttccacctctccacagcctacttccctctcctccctctccctctctcctactttactgggcctgccagggctgcgtcctaaccggcgtctgggtcatagcccacgagtgcggccaccacgccttcagcgactac

SEQ ID NO: 1882 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcccctctactgggcctgccaaggctgcgtcctaacgggcctctgggtcatcgcccacgagtgcggccaccacgccttcagcgactac

SEQ ID NO: 1883 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccagccctcgcccctctacggggcctgccaaggctgcgtcctaacgggcctctgggtcatcgcccacgaatgcggccaccacgccttcgcgactac

SEQ ID NO: 1884 - DNA, 358 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctcgtctggcccctctactgggcctgccaaggctgcgtcctaacgggcctctgggtcatcgcccacgaatgcggccaccacgccttcagcgactac

SEQ ID NO: 1885 - DNA, 325 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctcccctacatggctgcgtcctaaccggcgtcttggtcatagcccacgagtgcggccaccacgccttcagcgactac

SEQ ID NO: 1886 - DNA, 356 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcatcatctcctcctcggctcctccctctaccacctctccacagcctacttccctctcctccctcaccctctctcctacttggcctctctactgggcctgccaagggtgcgtcctaaccggcgtctgggtcatagcccacgagtgcggccaccacgccttcagcgactac

SEQ ID NO: 1887 - DNA, 351 bp, Artificial
  Mutation in BnaC.FAD2.b introduced by TALE nuclease pair BnFAD2_T01
caggatccatgggtcaggtgggagaatgcaagtctctcctccctccagctcccccgaaaccaaaaccctcaaacgcgtcccctgcgagacaccacccttcactctcggagacctcaagaaagcaatcccacctcactgcttcaaacgccccatccctcgctccttctcctacctcctcttcgacatcctcgtctcctcctccccctcccacccctccacagccacctcccctctcccccccccccctcccccttaccccgctggcccctctactgggcctgccaaggctgcgtcctaacgggcctctgggtcatcgcccacgaatgcggccaccacgccttcagcgactac

SEQ ID NO: 1888 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccagggctgcgtcctaaccggcgtctgggtcatagcccacgagtgcggccaccacgccttcagcgactac

SEQ ID NO: 1889 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctcccccaccctcccccttacctctggcccctctactgggcctgccaaggctgcgtcctaacgggcctctgggtcatagcccacgagtgcggccaccacgccttcagcgactac

SEQ ID NO: 1890 - DNA, 356 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccgcctggcccctctactgggcctgccaaggctgcgtcctaacgggcctctgggtcatcgcccacgaatgcggccaccacgccttcagcgactac

SEQ ID NO: 1891 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctccgcctggcccctctactgggcctgccaaggctgcgtcctaacgggcctctgggtcatcgcccacgaatgcggccaccacgccgtcagcgactac

SEQ ID NO: 1892 - DNA, 326 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccccctctactgggcctgccaaggctgcgtcctaacgggcctctgggtcatcgcccacgaatgcggccaccacgccttcagcgactac

SEQ ID NO: 1893 - DNA, 313 bp, Artificial
  Mutation in BnaC.FAD2.b introduced by TALE nuclease pair BnFAD2_T01
aaggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgatccatcccacgttccttctcctcttcgacatcatcatctcctcctcggctcctccctctaccacctctccacagcctacttccctctgggtctgccaaggctgcttcctaacgggcctctgggacatcgcccacaagtgctgccaccacgccatgagcgactac

SEQ ID NO: 1894 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccatcaaacgcgtcccctgcgagacaccacccttcactctcggagacctcaagaaagcaatcccacctcactgcttcaaacgctccatccctccctccttctcctacctcctcttcgacatcctcgtctcctcctccctctaccacctctccacagcctactcccctctcctccctccccctctctcctacctctggcctctctactgggcctgccagggctgcgtcctaaccggcgtctgggtcatagcccacgagtgcggccaccacgccttcagcgactac

SEQ ID NO: 1895 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagccacgatggcggcaagcaggcgctggagcctggcccctctactgggcctgccaaggctgcgtcctaacgggcctctgggtcatagcccacgagtgcggccaccacgccttcagcgactac

SEQ ID NO: 1896 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttaccttggcccctctactgggcctgccaaggctgcgtcctaacgggcctctgggtcatcgcccacgaatgcggccaccacgccttcagcgactac

SEQ ID NO: 1897 - DNA, 345 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatcccacgctccttctcctcttcgacatcatcatctcctcctcggctcctccctctaccacctctccacagcctacttccctctcctcccccaccctctccactggcccctctactgggcctgccaaggctgcgtcctaacgggcctctgggtcatcgcccacgaatgcggccaccacgccttcagcgactac

SEQ ID NO: 1898 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacccctctactgggcctgccaaggctgcgtcctaacgggcctctgggtcatcgcccacgaatgcggccaccacgccttcagcgactac

SEQ ID NO: 1899 - DNA, 422 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctcccccaccctctcccttacccctccagcggctgttgccggtgctgtgccaggcccacggcttgaccccggagcaggtggtggccatcgccagccacgatggtggcccctctactgggcctgccaaggctgcgtcctaacgggcctctgggtcatcgcccacgaatgcggccaccacgccttcagcgactac

SEQ ID NO: 1900 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 1901 - DNA, 261 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttccacatcatcatctcttcctcggctcctccctctcccgcctctccacagcctccttccctctcccctaccacgccttcagcgactac

SEQ ID NO: 1902 - DNA, 261 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatcccacgctccttctcctcttcgacatcatcatctcctcctcggctcctccctctaccacctctccacagcctacttccctctcccttaccacgccttcagcgactac

SEQ ID NO: 1903 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacccctctactgggcctgccaaggctgcgtcctaacgggcctctgggtcatagcccacgagtgcggccaccacgccttcagcgactac

SEQ ID NO: 1904 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatctcacgctccttctcctcttcgacatcatcatctcctcctcggctcctccctctaccacctctccacagcctacttccctctcccttacctcgccgcctggtccctctactgggcctgccaaggctgcgtcctaacgggcctctgggtcatcgcccacgaatgcggccaccacgccttcagcgactac

SEQ ID NO: 1905 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcgcctggcccctctactgggcctgccaaggctgcgtcctaacgggcctctgggtcatcgcccacgaacgcggccaccacgccttcagcgactac

SEQ ID NO: 1906 - DNA, 314 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctcctactttggcctctctactgggcctgccaagggtgcgtcctaaccggcgtctgggtcatagcccacgagtgcggccaccacgccttcagcgactac

SEQ ID NO: 1907 - DNA, 355 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaacaccctcaaacgcgtcccctgcgagacaccaccattcactctcggagacctcaagaaagcaatccctcctcactgcttcaaacgctccatcccacgctccttctcctcttcgacatcatcatctcctcctcggctcctccctctaccacctctccacaccctacttccctctcctcccccaccctctcccttaccgcgccctggcccctctactgggcctgccaaggctgcgtcctaacgggcctctgggtcatagcccacgagtgcggccaccacgccttcagcgactac

SEQ ID NO: 1908 - DNA, 422 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttcccgcgttgccggtgctgtgccaggcccacggcttgaccccggagcaggtggtggccatcgccagcaatattggtgctggcccctctactgggcctgccaaggctgcgtcctaacgggcctctgggtcatcgcccacgaatgcggccaccacgccttcagcgactac

SEQ ID NO: 1909 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctccgcctggcccctctactgggcctgccaaggctgcgtcctaacgggcctctgggtcatagcccacgagtgcggccaccacgccttcagctactac

SEQ ID NO: 1910 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctacggggcctgccaaggctgcgtcctaacgggcctctgggtcatcgcccacgaatgcggccaccacgccttcagcgactac

SEQ ID NO: 1911 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctcttcgacatcatcatctcctcctccctctaccacctctccacagcctacttccctctcctcccccaccctctcccttaccttggcccctctactgggcctgccaaggctgcgtcctaacgggcctctgggtcatcgcccacgagtgcggccaccacgccttcagcgactac

SEQ ID NO: 1912 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcggcccctctactgggcctgccaaggctgcgtcctaacgggcctctgggtcatcgcccacgaatgcggccaccacgccttcagcgactac

SEQ ID NO: 1913 - DNA, 381 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttgcctcgctcgccgcagccgaacgaccgagcgcagcgtggcccctctactgggcctgccaagggtgcgtcctaaccggcgtctgggtcatagcccacgagtgcggccaccacgccttcagcgactac

SEQ ID NO: 1914 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctatggcctctctactgggcctgccaagggtgcgtcctaaccggcgtctgggtcatagcccacgagtgcggccaccacgccttcagcgactac

SEQ ID NO: 1915 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctactggcctctctactgggcctgccaagggtgcgtcctaaccggcgtctgggtcatagcccacgagtgcggccaccacgccttcagcgactac

SEQ ID NO: 1916 - DNA, 312 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcctcttcgacatcctcgtctcctcctccctctaccacctctccacagcctacttccctctgggtctgccaaggctgcgtcctaacgggcctctgggtcatcgcccacgaatgcggccaccacgccttcagcgactac

SEQ ID NO: 1917 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctctccctcacccggcccctctactgggcctgccaaggctgcgtcctaacgggcctctgggtcatagcccacgagtgcggccaccacgccttcagcgactac

SEQ ID NO: 1918 - DNA, 356 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttcgcccctggcctctctactgggcctgccaagggtgcgtcctaaccggcgtctgggtcatagcccacgagtgcggccaccacgccttcagcgactac

SEQ ID NO: 1919 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctccccccccctctcccttacctggcccctctactgggcctgccaaggctgcgtcctaactggcctctgggtcatcgcccacgaatgcggccaccacgccttcagcgactac

SEQ ID NO: 1920 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccgtccctcccctctactgggcctgccaaggctgcgtcctaacgggcctctgggtcatcgcccacgaatgcggccaccacgccttcagcgactac

SEQ ID NO: 1921 - DNA, 326 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctcccctccccctctactgggcctgccaaggctgcgtcctaacgggcctctgggtcatcgcccacgaatgcggccaccacgccttcagcgactac

SEQ ID NO: 1922 - DNA, 350 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatcccacgctccttctcctcttcgacatcatcatctcctcctcggctcctccctctaccacctctccacagcctacttccctctcctcccccaccctctcccttcccttggcccctctactgggcctgccaaggctgcgtcctaacgggcgtctgggtcatagcccacgagtgcggccaccacgccttcagcgactac

SEQ ID NO: 1923 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttccctctccctcaccctctctcttggcctctctactgggcctgccaagggtgcgtcctaaccggcgtctgggtcatagcccacgagtgcggccaccacgccttcagcgactac

SEQ ID NO: 1924 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 1925 - DNA, 348 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactctcggagacctcaagaaagcaatcccacctcactgcttcaaacgcccatccctcgctccttctcctacctcctcttcgacatcctcgtctcctcctccctctaccacctctccacagcctacttccctctcctcccccaccctctcccttacctcggcccctctactgggcctgccaaggctgcgtcctaacgggcctctgggtcatcgcccacgaatgcggccaccacgccttcagcgactac

SEQ ID NO: 1926 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactcttggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggccctctactgggcctgccaaggctgcgtcctaacgggcctctgggtcatcgcccacgaatgcggccaccacgccttcagcgactac

SEQ ID NO: 1927 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatagcccacgagtgcggccaccacgccttcagcgactac

SEQ ID NO: 1928 - DNA, 261 bp, Artificial
  Mutation in BnaC.FAD2.b introduced by TALE nuclease pair BnFAD2_T01
caggatccatgggtgcaggtggaagaatgcaagtatctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttaccacgccttcagcgactac

SEQ ID NO: 1929 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatagcccacgagtgcggccaccacgccttcagcgactac

SEQ ID NO: 1930 - DNA, 336 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctgggcctgccaaggctgcgtcctaacgggcctctgggtcatagcccacgagtgcggccaccacgccttcagcgactac

SEQ ID NO: 1931 - DNA, 350 bp, Artificial
  Mutation in BnaC.FAD2.b introduced by TALE nuclease pair BnFAD2_T01
caggatccatgggtgcaggtggaagaatgcaattgtctcctccctccaagaagtctgaaaccgacaccatcaagcgcgtaccctgcgagacaccgcccttcactgtcggagacctcaagaaagcaatcccacctcactgcttcaaacgctccatccctcgctccttctcctacctcctcttcgacatcctcgtctcctcctccctctaccacctctccacagcctacttccctttcctcccccaccctctcccttacctctggcccctctactgggcctgccaaggctgcgtcctaacgggcctctgggtcatagcccgcgagtgcggccaccacgccttcagcgactac

SEQ ID NO: 1932 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatagcccacgagtgcggccaccacgccttcagcgactac

SEQ ID NO: 1933 - DNA, 348 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactctcggagacctcaagaaagcaatcccacctcactgcttcaaacgctccatccctcgctccttctcctacatcctcttcgacatcctcgtctcctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 1934 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctgcccctctactgggcctgccaaggctgcgtcctaacgggcctctgggtcatagcccacgagtgcggccaccacgccttcagcgactac

SEQ ID NO: 1935 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttgcctctctactgggcctgccaagggtgcgtcctaaccggcgtctgggtcatagcccacgagtgcggccaccacgccttcagcgactac

SEQ ID NO: 1936 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctctctctaccacctctccacatcctacttccctctcctccccccccctctcccttacctggcccctctacggggcctgccaaggctgcgtcctaacgggcctctgggtcatagccctcgagtgcggccaccacgccttcagcgactac

SEQ ID NO: 1937 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgcttcatcccacgctccttctcctcttcgacatcatcatctcctcctcggctcctccctctaccacctctccacagcctacttccctctcctccccccccctccccctggcccctctactgggcctgccaaggctgcgtcctaacgggcctctgggtcatcgcccacgaatgcggccaccacgccttcagcgactac

SEQ ID NO: 1938 - DNA, 387 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccatcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctcccccaccctctcccttacctcgggagcggatttgaacgttgtgaagcaccggcccggagggtggcgggcgtctctactgggcctgccaaggctgcgtcctaacgggcctctgggtcatcgcccacgaatgcggccaccacgccttcagcgactac

SEQ ID NO: 1939 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcctcccctcctccctctaccacctctccacagcctacttccctctcctcccccaccctctcccttcccttggcccctctactgggcctgccaaggctgcgtcctaacgggcctctgggtcatcgcccacgaatgcggccaccacgccttcagcgactac

SEQ ID NO: 1940 - DNA, 311 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctcaccctctctcctactggcctctctactgggcctgccagggctgcgtcctaaccggcgtctgggtcatagcccacgagtgcggccaccacgccttcagcgactac

SEQ ID NO: 1941 - DNA, 346 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttatggcccctctactgggcctgccaagggtgcgtcctaaccggcgtctgggtcatagcccacgagtgcggccaccacgccttcagcgactac

SEQ ID NO: 1942 - DNA, 340 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 1943 - DNA, 355 bp, Artificial
  Mutation in BnaC.FAD2.b introduced by TALE nuclease pair BnFAD2_T01
caggatccatgggtgcaggtggaagaatgcaagtgtctcctccctccacctcccccggaaccaacaccctcaaacgcgtcccctgcgagacaccaccattcactctcggagacctcaagaaagcaatcccacctaactgcttcaaacgctccatcccacgctccttctcctcttcgacatcatcatctcctcctcggctcctccctctaccacctctccacagcctacttccctctcctcccccaccctctcccttacctcgccctggcccctctactgggcctgccaaggctgcgtcctaacgggcctctgggtcatcgcccacgaatgcggccaccacgccatcagcgactac

SEQ ID NO: 1944 - DNA, 309 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtaccctgcgagacaccaccattcactctcggagacctcaagaaagcaatcccacctcactgcttcaaacgctccatcccacgctccttctcctcttcgacatcatcatctcctcctcggctcctccctcaccctctctcctaggcctctctactgggcctgccaagggtgcgtcctaacgggcctctgggtcatcgcccacgaatgcggccaccacgccttcagcgactac

SEQ ID NO: 1945 - DNA, 359 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctcgtctggcccctctactgggcctgccaaggctgcgtcctaacgggcctctgggtcatcgcccacgaatgcggccaccacgccttcagcgactac

SEQ ID NO: 1946 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctcccccaccctctcgcctggcccctctactgggcctgccaaggctgcgtcctaacgggcctctgggtcatcgcccacgaatgcggccaccacgccttcagcgactac

SEQ ID NO: 1947 - DNA, 334 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctctctactgggcctgccaagggtgcgtcctaacgggcctctgggtcatcgcccacgaatgcggccaccacgccttcagcgactac

SEQ ID NO: 1948 - DNA, 343 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgcttcaaacgctccatccctcgctccttctcctacctcctcttcgacatcctcgtctcctcctccctctaccacctctccacagcctacttccctctcctcccccaccctctcccttacccctctactgggcctgccaaggctgcgtcctaacgggcctctgggtcatagcccacgagggcggccaccacgccttcagcgactac

SEQ ID NO: 1949 - DNA, 349 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 1950 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctccctctaccacctctccacagcctacttccctctcctccccccccctctcccttacctggcccctctactgggcctgccaaggctgcgtcctaacgggcctctgggtcatcgcccacgaatgcggccaccacgccttcagcgactac

SEQ ID NO: 1951 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctccctctaccacctctccacagcctacttccctctcctccccccccctctcccttacctctggcccctctactgggcctgccaaggctgcgtcctaacgggcctctgggtcatcgcccacgaatgcggccaccacgccttcagcgactac

SEQ ID NO: 1952 - DNA, 326 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccccctctactgggcctgccaaggctgcgtcctaacgggcctctgggtcatcgcccacgaatgcggccaccacgccttcagtgactac

SEQ ID NO: 1953 - DNA, 343 bp, Artificial
  Mutation in BnaC.FAD2.b introduced by TALE nuclease pair BnFAD2_T01
caggatccatgggtgcagggggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctactctctactgggcctgccaagggtgcgtcctaaccggcgtctgggtcatagcccacgagtgcggccaccacgccttcagcgactac

SEQ ID NO: 1954 - DNA, 340 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaaacgcgtcccctgcgagacaccacccttcactctcggagacctcaagaaagcaatcccacctcactgcttcaaacgctccatccctcgctccgtctcctacctcctcttcgacatcctcgtctcctcctccctctaccacctctccacagcctccctccctcccccccccccccctccccccccctctactgggcctgccaagcctgcgtcctaacgggcctctgggtaatcgcccacgaatgcggccaccacgccttcagcgactac

SEQ ID NO: 1955 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaaacaatcccacctcactgcttcaaacgctccatcccacgctccttctcctcttcgacatcatcatctcctcctcggctcctccctctaccacctctccacagcctacttccctctcctcccccaccctctcccttacctctactgggcctgccaaggctgcgtcctaacgggcctctgggtcatcgcccacgaatgcggccaccacgccttcagcgactac

SEQ ID NO: 1956 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccactggcccctctactgggcctgccaaggctgcgtcctaacgggcctctgggtcatcgcccacgaatgcggccaccacgccttcagcgactac

SEQ ID NO: 1957 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtccactgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctctggcccctctactgggcctgccaaggctgcgtcctaacgggcctctgggtcatagcccacgagtgcggccaccacgccttcagcgactac

SEQ ID NO: 1958 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagccacgatggcggcaagcaggcgctggagcctggcccctctactgggcctgccaaggctgcgtcctaactggcctctgggtcatagcccacgagtgcggccaccacgccttcagcgactac

SEQ ID NO: 1959 - DNA, 355 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccacccttcactctcggagacctcaagaaagcaatcccacctcactgcttcaaacgctccatccctcgctccttctcctacctcctcttcgacatcctcgcctcctcctccctctcccacccctccacaccctacttccctctcctccctcaccctctctcctcctccgcccctggcctctctactgggcctgccaagggtgcgtcctaacgggcctctgggtcatagcccacgagtgcggccaccacgccttcagcgactac

SEQ ID NO: 1960 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctcttcgacatcatcatctcctcctcggctcctccctctaccacctctccacagcctacttccctctcctcccccaccctctcccctcccttggcccctctactgggcctgccaaggctgcgtcctaacgggcctctgggtcatcgcccacgaatgcggccaccacgccttcagcgactac

SEQ ID NO: 1961 - DNA, 345 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctaggcctctctactgggcctgccagggctgcgtcctaaccggcgtctgggtcatagcccacgagtgcggccaccacgccttcagcgactac

SEQ ID NO: 1962 - DNA, 353 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctaccgccctggcctctctactgggcctgccagggctgcgtcctaaccggcgtctgggtcatagcccacgagtgcggccaccacgccttcagcgactac

SEQ ID NO: 1963 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctccctcaccctctctcctacgtttactgggcctgccagggctgcgtcctaaccgtcgtctgggtcatagcccacgagtgcggccaccacgccttcagcgactac

SEQ ID NO: 1964 - DNA, 354 bp, Artificial
  Mutation in BnaC.FAD2.b introduced by TALE nuclease pair BnFAD2_T01
caggatccatgggtgcaggtggaagaatgcaagtctatcctccctccagctcccccggaaccaacaccctcaaacgcgtcccctgcgagacaccacccttcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctccgcctggcccctctactgggcctgccaaggctgcgtcctaacgggcctctgggtcatcgcccacgaatgcggccaccacgccttcagcgactac

SEQ ID NO: 1965 - DNA, 422 bp, Artificial
  Mutation in BnaC.FAD2.b introduced by TALE nuclease pair BnFAD2_T01
caggatccatgggtgcaggtggaagaatgcaagtctctcctccctccagctccctcgaaaccaaaaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctcccccttacctctggcaagcaggcgctggagacggtccagcggctgttgccggtgctgtgccaggcccacggcttgacccccctggcccctctactgggcctgccaagactgcgtcctaacggtcctctgggtcatcgcccacgaatgcggccaccacgccttcagcgactac

SEQ ID NO: 1966 - DNA, 381 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcccccccccccctctcccttacctcgctctccgcagccgaacgaccgagcgcagcgtggcccctctactgggcctgccaaggctgcgtcctaacgagcctctgggtcatcgcccgcgaatgcggccgccaccccctcagcgactac

SEQ ID NO: 1967 - DNA, 412 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctcgctggagacggtccagcggctgttgccggtgctgtgccaggcccacggcttgaccccggagctggcccctctactgggcctgccaaggctgcgtcctaacgggcctctgggtcatcgcccacgaatgcggccaccacgccttcagcgactac

SEQ ID NO: 1968 - DNA, 351 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttgcctctggcccctctactgggcctgccaaggctgcgtcctaacgggcctctgggtcatcgcccacgaatgcggccaccacgccttcagcgactac

SEQ ID NO: 1969 - DNA, 350 bp, Artificial
  Mutation in BnaC.FAD2.b introduced by TALE nuclease pair BnFAD2_T01
catgatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcatcgacatcatcatctcctcctcgtctcctcctccctctaccacctctccacagcctacttccctctcctcccccaccctctcccttacctgcccctctaccgggcctgccaaggctgcgtcataacgggcctctgggtcatcgcccacgaatgcggccaccacgccttcacgactac

SEQ ID NO: 1970 - DNA, 358 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctcgtctggcccctctactgggcctgccaaggctgcgtcctaacgggcctctgggtcatagcccacgagtgcggccaccacgccttcagcgactac

SEQ ID NO: 1971 - DNA, 349 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcccttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 1972 - DNA, 425 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttgcggatttgaacgttgtgaagcaacggcccggagggtggcgggccaccacctgctggggggtcaagccgtgggcctggcccctctactgggcctgccaaggctgcgtcctaacgggcctctgggtcatagcccacgagtgcggccaccacgccttcagcgactac

SEQ ID NO: 1973 - DNA, 341 bp, Artificial
  Mutation in BnaC.FAD2.b introduced by TALE nuclease pair BnFAD2_T01
caggatccatgggtgcaggtggaagaatgcaagtctcccctccctcaagctcccccgaaaccaaaaccctcaaacgcgtcccctgcgagccaccacccttcactctcggagacctcaagcaagcaatcccacctcactgcttcaaacgctccatcccacgctccttctcctcttccacatcatcatatcctcctcggcccctccctctaccaccactccacagcctacttccctctcctcccccaccctccccctccctctactgggcctgccaaggctgcgtccgaacgggcctctgggtcatcgcccacgaatgcggccaccacgccttcagcgactac

SEQ ID NO: 1974 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcttcccccaccctctcccttacctctggcccctctactgggcctgccaaggctgcgtcctaacgggcctctgggtcatagcccacgagtgcggccaccacgccttcagcgactac

SEQ ID NO: 1975 - DNA, 349 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactctcggagacctcaagaaagcaatcccacctcactgcttcaaacgctccatccctcgctccttctcctacctcctcttcgacatcctcgtctcctcctccctctaccacctctccacagcctacttccctctcctcccctaccctctcccttaccttggcccctctactgggcctgccaaggctgcgtcctaacgggcctctgggtcatcgcccacgaatgcggccaccacgccttcagcgactac

SEQ ID NO: 1976 - DNA, 351 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctcccccaccctctcccttacctcgcctcgtctggcccctctactgggcctgccaaggctgcgtcctaacgggcctctgggtcatcgcccacgaatgcggccaccacgccttcagcgactac

SEQ ID NO: 1977 - DNA, 352 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctccccccccctctcccttacctcgccggcccctctacggggcctgccaaggctgcgtcctaacgggcctctgggtcatcgcccacgaatgcggccaccacgccttcagcgactac

SEQ ID NO: 1978 - DNA, 350 bp, Artificial
  Mutation in BnaC.FAD2.b introduced by TALE nuclease pair BnFAD2_T01
caggatccatgggtgcaggtggaagaatgcaagtctctcctccatccagctcccccgaaaccaaaaccctcaaacgcgtcccctgcgagacaccacccttcactctcggagacctcaagaaagcaatcccaccgcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 1979 - DNA, 339 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctccgagacctcaagaaagcaatcccacctcactgcttcaaacgctccatcccacgctccttctcctcttcgacatcatcatctcctcctccctctaccacctctccacagcctacttccctctcctccccccccctctcccgtatggcccctctactgggcctgccaaggctgcgtcctaacgggcgtctgggtcatagcccacgagtgcggccaccacgccttcagcgactac

SEQ ID NO: 1980 - DNA, 350 bp, Artificial
  Mutation in BnaC.FAD2.b introduced by TALE nuclease pair BnFAD2_T01
caggatccatgggtgcaggtgcaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctcccccttacctctggcccctctactgggcctgccaaggctgcgtcctaacgggcctctgggtcatagcccacgagtgcggccaccacgccttcagcgactac

SEQ ID NO: 1981 - DNA, 324 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttcgcctggcctctctactgggcctgccaagggtgcgtcctaaccggcgtctgggtcatagcccacgagtgcggccaccacgccttcagcgactac

SEQ ID NO: 1982 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgtcgtggcccctctactgggcctgccaaggctgcgtcctaacgggcctctgggtcatcgcccacgaatgcggccaccacgccttcagcgactac

SEQ ID NO: 1983 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactcccggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 1984 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgctggcccctctactgggcctgccaaggctgcgtcctaacgggcctctgggtcatcgcccacgaatgcggccaccacgccttcagcgactac

SEQ ID NO: 1985 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaaccctccatccctcgctccttctcctacctcctcttcgacatcctcgtctcctcctccctctaccacctctccacagcctacttccctctcctcccccaccctctcccttacctctggcccctctactgggcctgccaaggatgcgtcctaacgggcctctgggtcatcgcccacgaatgcggccaccacgccttcagcgactac

SEQ ID NO: 1986 - DNA, 343 bp, Artificial
  Mutation in BnaC.FAD2.b introduced by TALE nuclease pair BnFAD2_T01
caggatccatgggtgcaggtggaagaatgcaagtctctcctccatccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctcgcccttacccctctactgggcctgccaaggctgcgtcctaacgggcctctgggtcatcgcccacgaatgcggccaccacgccttcagcgactac

SEQ ID NO: 1987 - DNA, 338 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccccccccccctcccctctactgggcctgccaaggctgcgtcctaacgggcctctgggtcatcgcccacgaaggcggccaccacgccttcagcgactac

SEQ ID NO: 1988 - DNA, 331 bp, Artificial
  Mutation in BnaC.FAD2.b introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccctggcccctctacggggcctgccaaggctgcgtcctaacgggcctctgggtcatcgcccacgaatgcggccaccacgccttcagcgactac

SEQ ID NO: 1989 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagcaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 1990 - DNA, 346 bp, Artificial
  Mutation in BnaC.FAD2.b introduced by TALE nuclease pair BnFAD2_T01
caggatccatgggtgcaggtgaaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctcccccttccctgccctctactgggcctgccaaggctgcgtcctaacgggcctctgggtcatagcccacgagtgcggccaccacgccttcagcgactac

SEQ ID NO: 1991 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcctccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagccacgatggcggcaagcaggcgctggagcctggcccctctactgggcctgccaaggctgcgtcctaacgggcctctgggtcatagcccacgagtgcggccaccacgccttcagcgactac

SEQ ID NO: 1992 - DNA, 373 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccattacctctccagcgcctgcttgccgccatcgtgcccctctactgggcctgccaaggctgcgtcctaacgggcctctgggtcatcgcccacgaatgcggccaccacgccttcagcgactac

SEQ ID NO: 1993 - DNA, 352 bp, Artificial
  Mutation in BnaC.FAD2.b introduced by TALE nuclease pair BnFAD2_T01
caggatccatgggtgcaggtggaagaatgcaagtctctactccctccagctcccccggacccaacacactcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagccaacttccctctcctccccccccctctcccttaccccgctggcccctctactggtcctgccaatgctgcgtcctaacgggcttctgggtcatcgccctcgaaggttgccacgacgccttcagcgactac

SEQ ID NO: 1994 - DNA, 350 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctccctgacctctggcccctctactgggccggccaaggcggcggccgagcgggcgtctgggtcatcgcccacgaaggcggccaccacgcctggagcgactac

SEQ ID NO: 1995 - DNA, 381 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttcccccgctcgccgcagccgaacgaccgagcgcagcgtggcccctctactgggcctgccaaggctgcgtcctaacgggcctctgggtcatcgcccacgaatgcggccaccacgccttcagcgactac

SEQ ID NO: 1996 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctctactgggcctgccagggctgcgtcctaacgggcctctgggtcatcgcccacgaatgcggccaccacgccttcagcgactac

SEQ ID NO: 1997 - DNA, 350 bp, Artificial
  Mutation in BnaC.FAD2.b introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctccctaacctctggcccctctactgggcctgccaaggctgcgtcctaacgggcctctgggtcatcgcccacaaatgcggccaccacgccttcagcgactac

SEQ ID NO: 1998 - DNA, 342 bp, Artificial
  Mutation in BnaC.FAD2.b introduced by TALE nuclease pair BnFAD2_T01
caggatccatgggtgcaggtggaagaatgcaagtatctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccctctactgggcctgccaaggctgcgtcctaacgggcctctgggtcatcgcccacgaatgcggccaccacgccttcagcgactac

SEQ ID NO: 1999 - DNA, 340 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccacccgcctggcccctctactgggcctgccaaggctgcgtcctaacgggcctctgggtcatagcccacgagtgcggccaccacgccttcagcgactac

SEQ ID NO: 2000 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctggcctctctactgggcctgccaagggtgcgtcctaaccggcgtctgggtcatcgcccacgaatgcggccaccacgccttcagcgactac

SEQ ID NO: 2001 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctccccccccctctcccttaccctggcccctctactgggcctgccaaggctgcgtcctaacgggcctctgggtcatcgcccacgaatgcggccaccacgccttcagcgactac

SEQ ID NO: 2002 - DNA, 337 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctcgcccctctactgggcctgccaaggctgcgtcctaacgggcctctgggtcatcgcccacgaatgcggccaccacgccttcagcgactac

SEQ ID NO: 2003 - DNA, 315 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaagcgcgtcccctgcgagacaccaccattcactctcggagacctcaagaaagcaatcccacctcactgcttcaaacgctccatcccacgctccttctcctcttccacatcatcctctcctcctcggctcctccctcaccctctctcctacctcctggcctctctactgggcctgccagggctgcgtcctaaccggcgtctgggtcatagcccacgagtgcggccaccacgccttcagcgactac

SEQ ID NO: 2004 - DNA, 350 bp, Artificial
  Mutation in BnaC.FAD2.b introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatagcccacgagtgcggccaccacgccttcagcgactac

SEQ ID NO: 2005 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctactttggcctctctactgggcctgccagggctgcgtcctaaccggcgtctgggtcatagcccacgagtgcggccaccacgccttcagcgactac

SEQ ID NO: 2006 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatagcccacgagtgcggccaccacgccttcagcgactac

SEQ ID NO: 2007 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctactggcctctctactgggcctgccaagggtgcgtcctaaccggcgtctgggtcatagcccacgagtgcggccaccacgccttcagcgactac

SEQ ID NO: 2008 - DNA, 349 bp, Artificial
  Mutation in BnaC.FAD2.b introduced by TALE nuclease pair BnFAD2_T01
caggatccatgggttcaggcggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctactttggcctctctactgggcctgccaagggtgcgtcctaaccggcgtctgggtcatagcccacgagtgcggccaccacgccttcagcgactac

SEQ ID NO: 2009 - DNA, 456 bp, Artificial
  Mutation in BnaC.FAD2.b introduced by TALE nuclease pair BnFAD2_T01
caggatccatgggtgcaggtggaagaatgcaagtgtcacctccctcaaagaagtctgaaaccgacaccatcaagcgcgtaccctgcgagacaccgcccttcactgtcggagaactcaagaaagcaatcccacctcactgcttcaaacgctccatcccacgctccttctcctcttcgacatcatcatctcctcctcggctcctccctctaccacctctccacagcctacttccctctcctcccccaccctcacccttaccgcgcctgctggcgatggccaccccctgctccggggtcaagccgtgggcctggcacagcaccggggcggcgtgaccgcagtggaggcagtgcatgcatggcgctcgcctggcccctctactgggcctgccaaggctgcgtcctaacgggcctctgggtcatcgcccacgaatgcggccaccacgccttcagcgactac

SEQ ID NO: 2010 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctccgggtcatcgcccacgaatgcggccaccacgccttcagcgactac

SEQ ID NO: 2011 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccccgcctggccctctactgggcctgccagggctgcgtcctaacgggcctctgggtcatagcccacgagtgcggccaccacgccttcagcgactac

SEQ ID NO: 2012 - DNA, 305 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctccctcaccctctctcctactttggcctctctactgggcctgccaaggctgcgtcctaacgggcctctgggacatagcccacgagtgcggccaccacgccttcagcgactac

SEQ ID NO: 2013 - DNA, 354 bp, Artificial
  Mutation in BnaC.FAD2.b introduced by TALE nuclease pair BnFAD2_T01
caggatccattggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccctggcccctctactgggcctgccaaggctgcgtcctaacgggcctctgggtcatcgcccacgaatgcggccaccacgccttcagcgactac

SEQ ID NO: 2014 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttcccttggcccctctactgggcctgccaaggctgcgtcctaacgggcctctgggtcatcgcccacgaatgcggccaccacgccttcagcgactac

SEQ ID NO: 2015 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttgctggcctctctactgggcctgccaagggtgcgtcctaaccggcgtctgggtcatagcccacgagtgcggccaccacgccttcagcgactac

SEQ ID NO: 2016 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctggcccctctactgggcctgccaaggctgcgtcctaacgggcctctgggtcatcgcccacgagtgcggccaccacgccttcagcgactac

SEQ ID NO: 2017 - DNA, 347 bp, Artificial
  Mutation in BnaC.FAD2.b introduced by TALE nuclease pair BnFAD2_T01
caggatccatgggtgcaggtggaagaatgcaagtctctcatccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctactggcctctctactgggccggccaagggtgcgtcctaaccggcgtctgggtcatagcccacgagtgcggccaccacgccttcagcgactac

SEQ ID NO: 2018 - DNA, 340 bp, Artificial
  Mutation in BnaC.FAD2.b introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccacccgcctggcccctctactgggcctgccaaggctgcgtcctaacgggcctctgggtcatcgcccacgaatgcggccaccacgccttcagcgactac

SEQ ID NO: 2019 - DNA, 261 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcacacgctccttctcctcttcgacatcatcatctcctcctcggctcctccctctaccacctctccacagcctacttccctctcccttaccacgccttcagcgactac

SEQ ID NO: 2020 - DNA, 354 bp, Artificial
  Mutation in BnaC.FAD2.b introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttcgccttggcctctctactgggcctgccagggctgcgtcctaaccggcgtctgggtcatagcccacgagtgcggccaccacgccttcagcgactac

SEQ ID NO: 2021 - DNA, 372 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctccagcggctgttgccgccatcgtgcccctctactgggcctgccaaggctgcgtcctaacgggcctctgggtcatagcccacgagtgcggccaccacgccttcagcgactac

SEQ ID NO: 2022 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctccaaccaggcctctctactgggcctgccaaggctgcgtcctaacgggcctctgggtcatagcccacgagtgcggccaccacgccttcagcgactac

SEQ ID NO: 2023 - DNA, 331 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctggcccctctactgggcctgccaaggctgcgtcctaacgggcctctgggtcatcgcccacgaatgcggccaccacgccttcagcgactac

SEQ ID NO: 2024 - DNA, 309 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctcaccctctctcctacttctctctactgggcctgccagggctgcgtcctaaccggcgtctgggtcatagcccacgagtgcggccaccacgccttcagcgactac

SEQ ID NO: 2025 - DNA, 353 bp, Artificial
  Mutation in BnaC.FAD2.b introduced by TALE nuclease pair BnFAD2_T01
caggatccattggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctccctggcccctctactgggcctgccaaggctgcgtcctaacgggcctctgggtcatcgcccacgaatgcggccaccacgccttcagcgactac

SEQ ID NO: 2026 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctctactgggcctgccaaggctgcgtcctaacgggcctctgggtcatagcccacgagtgcggccaccacgccttcagcgactac

SEQ ID NO: 2027 - DNA, 342 bp, Artificial
  Mutation in BnaC.FAD2.b introduced by TALE nuclease pair BnFAD2_T01
caggatccatgggtgcaggtggaagaatgcaagtctctcctcactccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagccacgatggcggcaagcaggcgctggagcctggcccctctactgggcctgccaaggctgcgtcctaacgggcctctgggtcatcgcccacgaatgcggccaccacgccttcagcgactac

SEQ ID NO: 2028 - DNA, 358 bp, Artificial
  Mutation in BnaC.FAD2.b introduced by TALE nuclease pair BnFAD2_T01
caggatccatgggtgcaggtggaagaatgcaagtctctcctccctccagctcccccggaaccaaaaccctcaaacgcgtcccctgcgagacaccacccttcactctcggagacctcaagaaagcaatcccacctcactgcttcaaacgctccatccctcgctccttctcctacctcatcttcgacatcctcgtctcctcctccctctaccacctctccacagcctacttccctctcctcccccaccctctcccttacctcgcctcgtctggcccctctactgggcctgccaaggctgcgtcctaacgggcctctgggtcatcgcccacgaatgcggccaccacgccttcagcgactac

SEQ ID NO: 2029 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctccctcaccctctctcctacttctctactgggcctgccagggctgcgtcctaaccggcgtctgggtcatagcccacgagtgcggccaccacgccttcagcgactac

SEQ ID NO: 2030 - DNA, 350 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 2031 - DNA, 261 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcgactcctccctctaccacctctccacagcctacttccctctcccttaccacgccttcagcgactac

SEQ ID NO: 2032 - DNA, 326 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctccccctctactgggcctgccaaggctgcgtcctaacgggcctctgggtcatcgcccacgaatgcggccaccacgccttcagcgactac

SEQ ID NO: 2033 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatagcccacgagtgcggccaccacgccttcagcgactac

SEQ ID NO: 2034 - DNA, 370 bp, Artificial
  Mutation in BnaC.FAD2.b introduced by TALE nuclease pair BnFAD2_T01
caggatccatgggtgcaggtggaagaacgcaagtcactcctccctccagctcccccgaaaccaaaaccctcaaacgcgtcccctgcgagacaccacccttcactctcggagacctcaagaaagcaatcccacctcactgcttcaaacgctccatccctcgctccttcctacctcctcttcgacatcctcgtctcctcctccctctaccacctctccacagcctacttccctctcctccccccccctctcccttacctctccagcggctgttgccgccatcgtgcccctctactgggcctgccaaggctgcgtcctaacgggcctctgggtcatcgcccacgaatgcggccaccacgccttcagcgactac

SEQ ID NO: 2035 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatccccgtctcctcctccctctaccacctctccacagcctacttccctctcctcccccaccctctcccttacctggcccctctactgggcctgccaaggctgcgtcctaacgggcctctgggtcatagcccacgagtgcggccaccacgccttcagcgactac

SEQ ID NO: 2036 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctcccccaccctctcccttacctctggcccctctactgggcctgccaaggctgcgtcctaaccggcgtctgtgtcatagcccacgagtgcggccaccacgccttcagcgactac

SEQ ID NO: 2037 - DNA, 345 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctccactggcccctctactgggcctgccaaggctgcgtcctaacgggcctctgggtcatcgcccacgaatgcggccaccacgccttcagcgactac

SEQ ID NO: 2038 - DNA, 260 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcccttaccacgccttcagcgactac

SEQ ID NO: 2039 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctggcccctctactgggcctgccaaggctgcgtcctaacgggcctctgggtcatcgcccacgaatgcggccaccacgccttcagcgactac

SEQ ID NO: 2040 - DNA, 358 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctcgtctggcccctctactgggcctgccaaggctgcgtcctaacgggcctctgggtcatcgcccacgaatgcggccaccacgccttcagcgactac

SEQ ID NO: 2041 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcgtagacctcaagaaagcaatcccacctcactgcttcaaacgctccatccctcgctccttctcctacctcctcttcgacatcctcgtctcctcctccctctaccacctctccacagcctacttccctctcctcccccaccctctctggcccctctactgggcctgccaaggctgcgtcctaacgggcctctgggtcatcgcccacgaatgcggccaccacgccttcagcgactac

SEQ ID NO: 2042 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatactcgtctcctcctccctctaccacctctcaacagcctacttccctctcctcccccaccctctccctcacctggcccctctactgggcctgccaaggctgcgtcctaacgggcctctgggtcatcgcccacgaatgcggccaccacgccttcagcgactac

SEQ ID NO: 2043 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctaggcctctctactgggcctgccaagggtgcgtcctaaccggcgtctgggtcatagcccacgagtgcggccaccacgccttcagcgactac

SEQ ID NO: 2044 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggacccacccccctcaaacccttccccttcgggccccaccccttccctctcggagacctaaaaaaagcattcccacctcactgcttcaaacgctcaatccctcgctccttctcctacctcctcttcgacatcctcgcctcctcccccctctacccccgctccacagcctacttccctctcctcccccaccctctcccttacccctctactgggcctgccaaggctgcgtcctaacgggcctctgggtcatcgcccacgaatgcggccaccacgccttcagcgactac

SEQ ID NO: 2045 - DNA, 394 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgggagcggatttgaacgttgtgaagcaacggcccggagggtggcgggcgtctctactgggcctgccaaggctgcgtcctaacgggcctctgggtcatcgcccacgaatgcggccaccacgccttcagcgactac

SEQ ID NO: 2046 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctaccgccctggcctctctactgggcctgccagggctgcgtcctaaccggcgtctgggtcatagcccacgagtgcggccaccacgccttcagcgactac

SEQ ID NO: 2047 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcatcatctcctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 2048 - DNA, 412 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccccgctggagacggtccagcggctgttgccggtgctgtgccaggcccacggcttgaccccggagctggcccctctactgggcctgccaaggctgcgtcctaacgggcctctgggtcatcgcccacgaatgcggccaccacgccttcagcgactac

SEQ ID NO: 2049 - DNA, 358 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctcgtctggcccctctactgggcctgccaaggctgcgtcctaacgggcctctgggtcatcgcccacgaatgcggccaccacgccttcagcgactac

SEQ ID NO: 2050 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgtgacaccacccttcactctcggagacctcaagaaagcaatcccacctcactgcttcaaacgctccatccctcgctccttctcctacctcctcttcgacatcctcgtctcctcctccctctaccacccctccacagcctacttccctctcccccccccccctcccccttccctcccctctactgggcctgccaaggctgcgtcctaacgggcctctgggtcatcgcccacgaatgcggcctccacgccttcagcgactac

SEQ ID NO: 2051 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccattacctcggcccctctactgggcctgccaaggctgcgtcctaacgggcctctgggtcatcgcccacgaatgcggccaccacgccttcagcgactac

SEQ ID NO: 2052 - DNA, 337 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcctcccccaccctcgcccctctactgggcctgccaaggctgcgtcctaacgggcctctgggtcatcgcccacgaatgcggccaccacgccttcagcgactac

SEQ ID NO: 2053 - DNA, 260 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcccttaccacgccttcagcgactac

SEQ ID NO: 2054 - DNA, 412 bp, Artificial
  Mutation in BnaC.FAD2.b introduced by TALE nuclease pair BnFAD2_T01
caggatccatgggtgcaggtggaagaatgcaagtctctcctccctccaactcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgctggagacggtccagcggctgttgccggtgctgtgccaggcccacggcttgaccccggagctggcccctctactgggcctgccaaggctgcgtcctaacgggcctctgggtcatcgcccacgaatgcggccaccacgccttcagcgactac

SEQ ID NO: 2055 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctccctggcccctctactgggcctgccaaggctgcgtcctaacgggcctctgggtcatcgcccacgaatgcggccaccacgccttcagcgactac

SEQ ID NO: 2056 - DNA, 418 bp, Artificial
  Mutation in BnaC.FAD2.b introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttagccgtagttaggccaccactccaagaaccctgtagcaccgcctacatacctcgctctgctaatcctgtaacctggcccctctactgggcctgccaaggctgcgtcctaacgggcctatgggtcatcgcccacgaatgcggccaccacgccttcagcgactac

SEQ ID NO: 2057 - DNA, 336 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccccctaccacctctccacagcctacttccccctccctttcccctggcccctctactgggcctgccaaggctgcgtcctaacgggcctctgggtcatcgcccacgaatgcggccaccacgccttcagcgactac

SEQ ID NO: 2058 - DNA, 418 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttagccgtagttaggccccccctccaagaactctgtagccccgcctacatacctcgctctgctaatcctgttacctggcccctctactgggcctgccaaggctgcgtcctaacgggcctctgggtcatcgcccacgaatgcggccaccacgccttcagcgactac

SEQ ID NO: 2059 - DNA, 349 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccagggctgcgtcctaaccggcgtcggggtcatagcccacgagtgcggccaccacgccttcagcgactac

SEQ ID NO: 2060 - DNA, 354 bp, Artificial
  Mutation in BnaC.FAD2.b introduced by TALE nuclease pair BnFAD2_T01
caggatccatgggtgcaggtggaagaatgcaagtatctcctcactccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctcccgctaccacctctccacagcctacttccctctcctcccccaccccctcccttacctcgccctgacccctctactgggcctgccaaggctgcgtcctaacgggcctctgggtcatcgcccacgaatgcggccaccacgccttcagcgactac

SEQ ID NO: 2061 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctactccgcggcctctctactgggcctgccaaggctgcgtcctaacgggcctctgggtcatcgcccacgaatgcggccaccacgccttcagcgactac

SEQ ID NO: 2062 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccccctctccacagcctacttccctctcctcccccaccctctcccttcccttggcccctctactgggcctgccgaggctgcgtcctaacgggcctctgggtcatagcccacgagtgcggccaccacgccttcagcgactac

SEQ ID NO: 2063 - DNA, 334 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatcccacgctccttctcctcttcgacatcatcatctcctcctccctctaccacctctccacagcctacttccctctcctcccccaccctctctggcccctctactgggcctgccaaggctgcgtcctaacgggcctctgggtcatcgcccacgaatgcggccaccacgccttcagcgactac

SEQ ID NO: 2064 - DNA, 350 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctctgacccctctactgggcctgccaaggctgcgtcctaacgggcctctgggtcatagcccacgagtgcggccaccacgccttcagcgactac

SEQ ID NO: 2065 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctggcccctctactgggcctgccaaggctgcgtcctaacgggcctctgggtcatcgcccacgagtgcggccaccacgccttcagcgactac

SEQ ID NO: 2066 - DNA, 261 bp, Artificial
  Mutation in BnaC.FAD2.b introduced by TALE nuclease pair BnFAD2_T01
caggatccatgggtgcaggtggaagaatgcaagtctctcctccctccagctcccccggaaccaaaaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttaccacgccttcagcgactac

SEQ ID NO: 2067 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttccctggcccctctactgggcctgccaaggctgcgtcctaacgggcctctgggtcatagcccacgagtgcggccaccacgccttcagcgactac

SEQ ID NO: 2068 - DNA, 347 bp, Artificial
  Mutation in BnaC.FAD2.b introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcccctctactgggcctgccaaggctgcgtcctaacgggcctctgggtcatcgcccacgaatgcggccaccacgccttcagcgactac

SEQ ID NO: 2069 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaatcaatcccacctcactgcttcaaacgctccatccctcgctccttctcctacctcctcttcgacatcctcgtctcctcctccctctaccacctctccacagcctacttccctctcctcccccaccctctcccttacctcgccctggcccctctactgggcctgccaaggctgcgtcctaacgggcctctgggtcatcgcccacgaatgcggccaccacgccttcagcgactac

SEQ ID NO: 2070 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctccgcctggcccctctactgggcctgccaaggctgcgtcctaacgggcctctgggtcatagcccacgagtgcggccaccacgccttcagcgactac

SEQ ID NO: 2071 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaaggcggccaccacgccttcagcgactac

SEQ ID NO: 2072 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctcgcctggcctctctactgggcctgccaagggtgcgtcctaaccggcgtctgggtcatagcccacgagtgcggccaccacgccttcagcgactac

SEQ ID NO: 2073 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgggcccctctacggggccggccaaggctgcgtcctaacgggcctctgggtcatcgccaacgaatgcggccaccacgccttcagcgactac

SEQ ID NO: 2074 - DNA, 381 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgctcgccgcagccgaacgaccgagcgcagcgtggcccctctactgggcctgccaaggctgcgtcctaacgggcctctgggtcatcgcccacgaatgcggccaccacgccttcagcgactac

SEQ ID NO: 2075 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctctactgggcctgccaaggctgcgtcctaacgggcctctgggtcatcgcccacgaatgcggccaccacgccttcagcgactac

SEQ ID NO: 2076 - DNA, 350 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 2077 - DNA, 334 bp, Artificial
  Mutation in BnaC.FAD2.b introduced by TALE nuclease pair BnFAD2_T01
caggatccatgggtgcaggtggaagaatgcaagtttctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctctactgggcctgccagggctgcgtcctaacgggcctctgggtcatagcccacgagtgcggccaccacgccttcagcgactac

SEQ ID NO: 2078 - DNA, 355 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctccctcaccctctctcctacttcgcccctggcctctctactgggcctgccaagggtgcgtcctaaccggcgtctgggtcatagcccacgagtgcggccaccacgccttcagcgactac

SEQ ID NO: 2079 - DNA, 342 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactctcggagacctcaagaaagcaatcccacctcactgcttcaaacgctccatccctcgctccttctcctacctcctcttcgacatcctcgtctcctcctccctctaccacctctccacagccacgatggcggcaagcaggcgctggagcctggcccctctactgggcctgccaaggctgcgtcctaacgggcctctgggtcatcgcccacgaatgcggccaccacgccttcagcgactac

SEQ ID NO: 2080 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccagggctgcgtcctaacgggcctctgggtcatagcccacgagtgcggccaccacgccttcagcgactac

SEQ ID NO: 2081 - DNA, 312 bp, Artificial
  Mutation in BnaC.FAD2.b introduced by TALE nuclease pair BnFAD2_T01
catgatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctcaccctctctcctacttggcctctctactgggcctgccagggctgcgtcctaacgggcctctgggtcatagcccacgagtgcggccaccacgccttcagcgactac

SEQ ID NO: 2082 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttggcccctctactgggcctgccaaggctgcgtcctaacgggcctctgggtcatcgcccacgaatgcggccaccacgccttcagcgactac

SEQ ID NO: 2083 - DNA, 381 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctcgctcgccgcaaccgaacgaccgagcgcagcgtggcccctctactgggcctgccaaggctgcgtcctaacgggcctctgggtcatcgcccacgaatgcggccaccacgccttcagcgactac

SEQ ID NO: 2084 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttcctcgcctggcccctctactgggcctgccaaggctgcgtcctaacgggcctctgggtcatcgcccacgaatgcggccaccacgccttcagcgactac

SEQ ID NO: 2085 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaactcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagccacgatggcggcaagcaggcgctggagcctggcccctctactgggcctgccaaggctgcgtcctaacgggcctctgggtcatcgcccacgaatgcggccaccacgccttcagcgactac

SEQ ID NO: 2086 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctactttggcctctctactgggcctgccaaggctgcgtcctaacgggcctctgggtcatagcccacgagtgcggccaccacgccttcagcgactac

SEQ ID NO: 2087 - DNA, 350 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcctccccccccctctcccttacctctggcccctctactgggcctgccaaggctgcgtcctaacgggcctctgggtcatcgcccacgaaggcggccaccacgccttcagcgactac

SEQ ID NO: 2088 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttcccttggcccctctactgggcctgccaaggctgcgtcctaacgggcctctgggtcatcgcccacgaatgcggccaccacgccttcagcgactac

SEQ ID NO: 2089 - DNA, 350 bp, Artificial
  Mutation in BnaC.FAD2.b introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 2090 - DNA, 349 bp, Artificial
  Mutation in BnaC.FAD2.b introduced by TALE nuclease pair BnFAD2_T01
caggatccatgggtgcaggtggaagaatgcaagtgtctcctccctccagctcccccgaaaccaaaaccctcaaacgcgtcccctgcgagacatcacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttcccttggcccctctactgggcctgccaaggctgcgtcctaacgggcctctgggtcatcgcccacgagtgcggccaccacgccttcagcgactac

SEQ ID NO: 2091 - DNA, 261 bp, Artificial
  Mutation in BnaC.FAD2.b introduced by TALE nuclease pair BnFAD2_T01
caggatccatgggtgcaggtggaagaatgctagtgtctcctccctccaagaagtctgaaaccgacaccatcaagcgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttacctcgccttcagcgactac

SEQ ID NO: 2092 - DNA, 344 bp, Artificial
  Mutation in BnaC.FAD2.b introduced by TALE nuclease pair BnFAD2_T01
caggatccatgggtgcaggtggaagaatgcaagtttctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcgcctggcccctctactgggcctgccaaggctgcgtcctaacgggcctctgggtcatagcccacgagtgcggccaccacgccttcagcgactac

SEQ ID NO: 2093 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggcggcgtcctaacaggcctctgggtcatcgcccacgaatgcggccaccacgccttcagcgactac

SEQ ID NO: 2094 - DNA, 338 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccacctcactgcttcaaacgctccatccctcgctccttctcctacctcctcttcgacatcctcgtctcctcctccctctaccacctctccacagcctacttccctctcctcccccaccctctccccctctactgggcctgccaaggctgcgtcctaacgggcctctgggtcatagcccacgagtgcggccaccacgccttcagcgactac

SEQ ID NO: 2095 - DNA, 356 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctccttcctggcccctctactgggcctgccaaggctgcgtcctaaccggcgtctgggtcatagcccacgagtgcggccaccacgccttcagcgactac

SEQ ID NO: 2096 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgagtgcggccaccacgccttcagcgactac

SEQ ID NO: 2097 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctactggcctctctactgggcctgccaagggtgcgtcctaaccggcgtctgggtcatagcccacgagtgcggccaccacgccttcagcgactac

SEQ ID NO: 2098 - DNA, 344 bp, Artificial
  Mutation in BnaC.FAD2.b introduced by TALE nuclease pair BnFAD2_T01
caggatcctgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctacctcctcttcgacatcctcgtctcctcctccctctaccacctctccacagcctacttccctctcctccctcaccctctctccttggcctctctactgggcctgccaagggtgcgtcctaaccggcgtctgggtcatagcccacgagtgcggccaccacgccttcagcgactac

SEQ ID NO: 2099 - DNA, 425 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccttctcccttacctggcggatttgaacggtgtgaagcaacggcccggagggtggcgggccaccgcctgctggggggtcaagccgtgggcctggcccctctactgggcctgccaaggctgcgtcctaacgggcctctgggtcatcgcccacgaatgcggccaccacgccttcagcgactac

SEQ ID NO: 2100 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccctggcccctctactgggcctgccaaagctgcgtcctaacgggcctctgggtcatcgcccacgaatgcggccaccacgccttcagcgactac

SEQ ID NO: 2101 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatacctcgctccttctcctacctcctcttcgacatcctcgtctcctcctccctctaccacctctccacagcctacttccctctcctcccccaccctctcccttaccttggcccctctactgggcctgccaagggtgcgtcctaaccggcgtctgggtcatagcccacgagtgcggccaccacgccttcagcgactac

SEQ ID NO: 2102 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccatctcctacctcctcttcgacatcctcgtctcctcctccctctaccacctctccacagcctacttccctctcctcccccaccctctccctggcccctctactgggcctgccaaggctgcgtcctaacgggcctctgggtcatcgcccacgaatgcggccaccacgccttcagcgactac

SEQ ID NO: 2103 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacatcctacttccctctcctccccctccctctctcctacttggcctctctactgggcctgccagggctgcgtcctaaccggcgtctgggtcatagcccacgagtgcggccaccacgccttcagcgactac

SEQ ID NO: 2104 - DNA, 345 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccccaccctctcccttatggcccctctactgggcctgccaaggctgcgtcctaacgggcctctgggtcatcgcccacgaatgcggccaccacgccttcagcgactac

SEQ ID NO: 2105 - DNA, 326 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctccccctctactgggcctgccaaggctgcgtcctaacgggcctctgggtcatcgcccacgaatgcggccaccacgccttcagcgactac

SEQ ID NO: 2106 - DNA, 354 bp, Artificial
  Mutation in BnaC.FAD2.b introduced by TALE nuclease pair BnFAD2_T01
caggatccatgggtgcaggtggaagaatgcaagtctatactccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctccgcctggcccctctactgggcctgccaaggctgcgtcctaacgggcctctgggtcatcgcccacgaatgcggccaccacgccttcagcgactac

SEQ ID NO: 2107 - DNA, 354 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctcgccctggcccctctactgggcctgccaaggctgcgtcctaacgggcctctgggtcatcgcccacgaatgcggccaccacgccttcagcgactac

SEQ ID NO: 2108 - DNA, 336 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctgggcctgccaaggctgcgtcctaacgggcctctgggtcatagcccacgagtgcggccaccacgccttcagcgactac

SEQ ID NO: 2109 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccccctctactgggcctgccaaggctgcgtcctaacgggcctctgggtcatagcccacgagtgcggccaccacgccttcagcgactac

SEQ ID NO: 2110 - DNA, 333 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccacctcactgcttcaaacgctccatcccacgctccttctcctcttcgacatcatcatctcctcctcggctcctccctctaccacctctccacagcctacttccctctcctccctcaccctctctcctgggcctgccaagggtgcgtcctaaccggcgtctgggtcatagcccacgagtgcggccaccacgccttcagcgactac

SEQ ID NO: 2111 - DNA, 349 bp, Artificial
  Mutation in BnaC.FAD2.b introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaaccggcgtctgggtcatagcccacgagtgcggccaccacgccttcagcgactac

SEQ ID NO: 2112 - DNA, 394 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctaagggcgagatccggtgcagattatttggattgagagtgaatattgcccctctactgggcctgccaaggctgcgtcctaacgggcctctgggtcatcgcccacgaatgcggccaccacgccttcagcgactac

SEQ ID NO: 2113 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccgcgcctggccctctactgggcctgccaaggctgcgtcctagcgggcctctgggtcatagcccacgagtgcggccaccacgccttcagcgactac

SEQ ID NO: 2114 - DNA, 349 bp, Artificial
  Mutation in BnaC.FAD2.b introduced by TALE nuclease pair BnFAD2_T01
caggatccatgggtgcaggtgcaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcggcccctctactgggcctgccaaggctgcgtcctaacgggcctctgggtcatcgcccacgaatgcggccaccacgccttcagcgactac

SEQ ID NO: 2115 - DNA, 338 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcttcatggcctcctgcttctactacgtcgccaccacttacttccctctcctccctcaccctctctccttggcctctctactgggcctgccaagggtgcgtcctaaccggcgtctgggtcatagcccacgagtgcggccaccacgccttcagcgactac

SEQ ID NO: 2116 - DNA, 345 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcgcctggcccctctactgggcctgccaaggctgcgtcctaacgggcctctgggtcatcgcccacgaatgcggccaccacgccttcagcgactac

SEQ ID NO: 2117 - DNA, 343 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctccttctcctcttcgacatcctcgtctcctcctccctctaccacctctccacagcctacttccctctcctccccccccctcccccttacccctggcccctctactgggcctgccaaggctgcgtcctaacgggcctctgggtcatcgcccacgagtgcggccaccacgccttcagcgactac

SEQ ID NO: 2118 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtaatcgcccacgaatgcggccaccacgccttcagcgactac

SEQ ID NO: 2119 - DNA, 372 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctccagcggctgttgccgccatcgtgcccctctacggggccttccaaggctgcgtcctaacgggcctctgggtcatcgcccacgaatgcggccaccacgccttcagcgactac

SEQ ID NO: 2120 - DNA, 260 bp, Artificial
  Mutation in BnaC.FAD2.b introduced by TALE nuclease pair BnFAD2_T01
caggatccatgggtgcaggtggaagaatgcaagtctctcctccctccagctcccccggaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcccttaccacgccttcagcgactac

SEQ ID NO: 2121 - DNA, 347 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgcctctactgggcctgccaaggctgcgtcctaacgggcctctgggtcatcgcccacgaatgcggccaccacgccatcagcgactac

SEQ ID NO: 2122 - DNA, 340 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctccctccctctactgggcctgccaaggctgcgtcctaacgggcctctgggtcatcgcccacgaatgcggccaccacgccttcagcgactac

SEQ ID NO: 2123 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttgcctctggcccctctactgggcctgccaaggctgcgtcctaacgggcctctgggtcatcgcccacgaatgcggccaccacgccttcagcgactac

SEQ ID NO: 2124 - DNA, 356 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgccgcctggcccctctactgggcctgccaaggctgcgtcctaacgggcctctgggtcatcgcccacgaatgcggccaccacgccttcagcgactac

SEQ ID NO: 2125 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacggcctctctactgggcctgccagggctgcgtcctaaccggcgtctgggtcatagcccacgagggcggccaccacgccttcagcgactac

SEQ ID NO: 2126 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccacccactcccgcacctaggcccctctactgggcctaccaaggctgcgtcctaacgggccggtgggtcatcgcccacgaatacgtccaccacgccttcagcggtac

SEQ ID NO: 2127 - DNA, 430 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctcccccttccctctccagcggctgtggccggtgctgtgccaggcccacggctggacccctcagcaggtggtggccatcgccagccacgatggtggcccctctactgggcctgccaaggctgcgtcctaacgggcctctgggtcatcgcccacgaatgcggccaccacgccttcagcgactac

SEQ ID NO: 2128 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaaccggcgtctgggtcatagcccacgagtgcggccaccacgccttcagcgactac

SEQ ID NO: 2129 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctggcccctctactgggcctgccaaggctgcgtcctaacgggcctctgggtcatagcccacgagtgcggccaccacgccttcagcgactac

SEQ ID NO: 2130 - DNA, 349 bp, Artificial
  Mutation in BnaC.FAD2.b introduced by TALE nuclease pair BnFAD2_T01
caggatccatgggtgcaggtggaagaatgcaagtttctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacaccctacttccctctcctcccccaccctcgcccttaccttggcccctctactgggcctgccaaggctgcgtcctaacgggcctctgggtcatcgcccacgaatgcggccaccacgccttcagcgactac

SEQ ID NO: 2131 - DNA, 348 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttaccttggcccctctactgggcctgccaagggtgcgtcctaaccggcgtctgggtcatagcccacgagtgcggccaccacgccttcagcgctac

SEQ ID NO: 2132 - DNA, 355 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctccttcctcgcccctctactgggcctgccaaggctgcgtcctaacgggcctctgggtcatagcccacgagtgcggccaccacgccttcagcgactac

SEQ ID NO: 2133 - DNA, 356 bp, Artificial
  Mutation in BnaC.FAD2.b introduced by TALE nuclease pair BnFAD2_T01
caggatccatgggtgcaggtgcaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccgcctggcccctctactgggcctgccaaggctgcgtcctaacgggcctctgggtcatcgcccacgaatgcggccaccacgccttcagcgactac

SEQ ID NO: 2134 - DNA, 356 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctcgccgcctggcccctctactgggcctgccaaggctgcgtcctaaccggcgtctgggtcatagtccacgagtgcggccaccacgccttcagcgactac

SEQ ID NO: 2135 - DNA, 348 bp, Artificial
  Mutation in BnaC.FAD2.b introduced by TALE nuclease pair BnFAD2_T01
caggatccatgggtgcaggtggaagaatgcaagtctatcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctagcgggcctctgggtcatcgcccacgaattcggccaccacgccttcagcgactac

SEQ ID NO: 2136 - DNA, 356 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccacctggcccctctactgggcctgccaaggctgcgtcctaacgggcctctgggtcatcgcccacgaatgcggccaccacgccttcagcgactac

SEQ ID NO: 2137 - DNA, 355 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctccttcctggcccctctactgggcctgccaaggctgcgtcctaacgggcctctgggtcatcgcccacgaatgcggccaccacgccttcagcgactac

SEQ ID NO: 2138 - DNA, 313 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagatagcaatcccacctcactgcttcaaacgctccatcccacgctccttctcctcttcgacatcatcatctcctcctcggctcctccctctaccacctctccacagcctacttccctctgggtctgccaaggctgcgtcctaacgggcctctgggtcatagcccacgagtgcggccaccacgccttcagcgactac

SEQ ID NO: 2139 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcccacttggcccctctactgggcctgccaaggctgcgtcctaaccggcgtctgggtcatcgcccacgaatgcggccaccacgccttcagcgactac

SEQ ID NO: 2140 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttgcctctctactgggcctgccaagggtgcgtcctaacgggcctctgggtcatcgcccacgaatgcggccaccacgccttcagcgactac

SEQ ID NO: 2141 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctctgagacctcaagaaagcaatcccacctcactgcttcaaacgctccatcccacgctccttctcctcttcgacatcatcatctcctcctcggctcctccctctaccacctctccacagcctacttccctctcctcccccaccctctccctgacccctctactgggcctgccagggctgcgtcctaaccggcgtctgggtcatagcccacgaggtcggccaccacgccttcagcgactac

SEQ ID NO: 2142 - DNA, 345 bp, Artificial
  Mutation in BnaC.FAD2.b introduced by TALE nuclease pair BnFAD2_T01
caggatccatgggtgcaggtggaagaatgcaagtctatcctccctccagctcccccggaaccaacaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcgcctggcccctctactgggcctgccaaggctgcgtcctaacgggcctctgggtcatcgcccacgaatgcggccaccacgccttcagcgactac

SEQ ID NO: 2143 - DNA, 348 bp, Artificial
  Mutation in BnaC.FAD2.b introduced by TALE nuclease pair BnFAD2_T01
caggatccatgggtgcaggtggaagaatgcaagtgtatcctccctccaaaaagtctgaaaccgacaacatcaagcgcataccctgcgagacaccgcccttaactgtcggagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 2144 - DNA, 350 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 2145 - DNA, 341 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatcccacgctccttctcctcttcgacatcatcatctcctcctcggctcctccctctaccacctctccacagcctacttccctctcccttacctccttcctggcccctctactgggcctgccaaggctgcgtcctaacgggcctctgggtcatcgcccacgaatgcggccaccacgccttcagcgactac

SEQ ID NO: 2146 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccctaccctctcccttcccttggcccctctactgggcctgccaaggctgcgtcctaacgggcctctgggtcatcgcccacgaatgcggccaccacgccttcagcgactac

SEQ ID NO: 2147 - DNA, 349 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttcccttggcccctctactgggcctgccaagactgcgtcctaacgggcctctgggtcatagcccacgagtgcggccaccacgccttcagcgactac

SEQ ID NO: 2148 - DNA, 356 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccgcctggcccctctactgggcctgccaaggctgcgtcctaacgggcctctgggtcatcgcccacgaatgcggccaccacgccttcagcgactac

SEQ ID NO: 2149 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttccctggcccctctactgggcctgccaaggctgcgtcctaacgggcctctgggtcatcgcccacgaatgcggccaccacgccttcagcgactac

SEQ ID NO: 2150 - DNA, 455 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttcccccgcctgctggcgatggccaccacctgctccggggtcaagccgtgggcctggcacagccccggggcggcgtgaccgcagtggaggccgtgcatgcatggcgctcgcctggcccctctactgggcctgccaaggctgcgtcctaacgggcctctgggtcatagcccacgagtgcggccaccacgccttcagcgactac

SEQ ID NO: 2151 - DNA, 348 bp, Artificial
  Mutation in BnaC.FAD2.b introduced by TALE nuclease pair BnFAD2_T01
caggatccatgggtgcaggtggaagaatgcaagtctctcctccctacagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 2152 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctcgggcccctctactgggcctgccaaggctgcgtcctaacgggcctctgggtcatcgcccacgaatgcggccaccacgccttcagcgactac

SEQ ID NO: 2153 - DNA, 403 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctcggctcctccctctaccacctctccacagcctacttccctctcctccctccccctctctcctacttcgccgcagactcttcctggctagcggtacgcgtattaattgcgtcctgacctctctactgggcctgccaaggctgcgtcctaacgggcctctgggtcatagcccacgagtgcggccaccacgccttcagcgactac

SEQ ID NO: 2154 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 2155 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctagcctctctactgggcctgccagggctgcgtcctaaccggcgtctgggtcatagcccacgagtgcggccaccacgccttcagcgactac

SEQ ID NO: 2156 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccgccctctcccttacccctggcccctctactggtcctgccaaggctgcgtcctaacgggcctctgggtcatcgcccacgaatgcggccaccacgccttcagcgactac

SEQ ID NO: 2157 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttaccctctactgggcctgccaaggctgcgtcctaacgggcctctgggtcatcgcccacgaatgcggccaccacgccttcagcgactac

SEQ ID NO: 2158 - DNA, 338 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccctctactgggcctgccaaggctgcgtcctaacgggcctctgggtcatcgcccacgaatgcggccaccacgccttcagcgactac

SEQ ID NO: 2159 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctcccccaccctctcccttacccctctactgggcctgccaaggctgcgtcctaacgggcctctgggtcatcgcccacgaatgcggccaccacgccttcagcgactac

SEQ ID NO: 2160 - DNA, 348 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttccctggcccctctactgggcctgccaaggctgcgtcctaacgggcctctgggtcatcgcccacgaatgcggccaccacgccttcagcgactac

SEQ ID NO: 2161 - DNA, 348 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatccctcgctccttctcctacctcctcttcgacatcctcgtctcctcctccctctaccacctccccacagcctacttccctctcctccccccccctctccctcccctcgcccctctactgggcctgccaaggctgcgtcctaacgggcctctgggtcatcgcccacgaatgcggccaccacgccttcagcgactac

SEQ ID NO: 2162 - DNA, 327 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatcccacgctccttctcctcttcgacatcatcatctcctcctcggctcctccctctaccacctctccacagcctacttccctctcctccccctctactgggcctgccaaggctgcgtcctaacgggcctctgggtcatcgcccacgaatgcggccaccacgccttcagcgactac

SEQ ID NO: 2163 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcccctctactgggcctgccaaggctgcgtcctaacgggcctctgggtcatcgcccacgaatgcggccaccacgccttcagcgactac

SEQ ID NO: 2164 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgagtgcggccaccacgccttcagcgactcc

SEQ ID NO: 2165 - DNA, 425 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctcccccgtaccttgcggatttgaccttggtgaagcaccggcccggagggtggcgggccaccccctgctggggtgtcaagccgtgggcctggcccctctactgggcctgccaaggctgcgtcctaacgggcctctgggtcatcgcccacgaatgcggccaccacgccttcagcgactac

SEQ ID NO: 2166 - DNA, 356 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccgcctggcccctctactgggcctgccaaggctgcgtcctcacgggcctctgggtcatcgcccacgaatgcggccaccacgccatcagcgactcc

SEQ ID NO: 2167 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccaccgcctacttccctctcctcccccaccctctcccttcccccggcccctctactgggcctgccaaggctgcgtcctaacgggcgtctgggtcatagcccacgagtgcggccaccacgccttcagcgactac

SEQ ID NO: 2168 - DNA, 347 bp, Artificial
  Mutation in BnaC.FAD2.b introduced by TALE nuclease pair BnFAD2_T01
caggatccatgggtgcaggtgcaagaatgcaagtctctcctccctccagctcccccgaacccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccgccctctcccttaccggcccctctactgggcctgccaaggctgcgtcctaacgggcctctggggcatcgcccacgaatgcggccaccacgccttcagcgactac

SEQ ID NO: 2169 - DNA, 344 bp, Artificial
  Mutation in BnaC.FAD2.b introduced by TALE nuclease pair BnFAD2_T01
caggatccatgggtgcaggtggaagaatgcaagtctctcctccctccaactcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttggcccctctactgggcctgccaaggctgcgtcctaacgggcctctgggtcatcgcccacgaatgcggccaccacgccttcagcgactac

SEQ ID NO: 2170 - DNA, 351 bp, Artificial
  Mutation in BnaC.FAD2.b introduced by TALE nuclease pair BnFAD2_T01
caggatccatgggtgcaggtgaaagaatgcaagtctctcctccctccagctcccccgaaaccaaaaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 2171 - DNA, 328 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatcccacgctccttctcctcttcgacatcatcatagcctcctgcttctactacgtcgccaccacttacttccctctcctccctcaccctctctcctacttagcctgccaagggtgcgtcctaaccggcgtctgggtcatagcccacgagtgcggccaccacgccttcagcgactac

SEQ ID NO: 2172 - DNA, 349 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctccccccccctctcccttaccttggcccctctactgggcctgccaaggctgcgtcctaacgggcctctgggtcatcgcccacgaatgcggccaccacgccttcagcgactac

SEQ ID NO: 2173 - DNA, 422 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatcccacgctccttctcctcttcgacatcatcatctcctcctccctctaccacctctccacagcctacttccctctcctcccccaccctctcccttacctctccagcggctgttgccggtgctgtgccaggcccacggcttgacccctcagcaggtggtggccatcgccagccacgatggtggcccctctactgggcctgccaaggctgcgtcctaacgggcctctgggtcatcgcccacgaatgcggccaccacgccttcagcgactac

SEQ ID NO: 2174 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcggcctctctactgggcctgccaagggtgcgtcctaaccggcgtctgggtcatagcccacgagtgcggccaccacgccttcagcgactac

SEQ ID NO: 2175 - DNA, 332 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctcaatcccacgctccttctcctcttcgacatcatcatctcctcctcggctcctccctctaccacctctccacagcctacttccctctcccttacctcccctctactgggcctgccaaggctgcgtcctaacgggcctcggggtcatcgcccacgaatgctgccacctcgccatcagcgactac

SEQ ID NO: 2176 - DNA, 350 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgcttcaaacgctccatcccacgctccttctcctcttcgacatcatcatctcctcctcggctcctccctctaccacctctccacagcctacttccctctcctccccctccctctcccttcccttggcccctctactgggcctgccaaggctgcgtcctaacgggcctctgggtcatcgcccacgaatgcggccaccacgccttcagcgactac

SEQ ID NO: 2177 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctccctctaccacctctccacagcctacttccctctcctccctcaccctctctcctacttcgcctctctactgggcctgccaagggtgcgtcctaaccggcgtctgggtcatagcccacgagtgcggccaccacgccttcagcgactac

SEQ ID NO: 2178 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccgtaccttggcccctctacggggcctgccaaggctgcgtcctaacgggcctctgggtcatcgcccacgaatgcggccgccacgccttcagcgactac

SEQ ID NO: 2179 - DNA, 331 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctctttctcctacctcctcttcgacatcctcgtctcctcctccctctaccacctctccacagcctacttccctctcctccctggcccctctactgggcctgccaaggctgcgtcctaacgggcctctgggtcatagcccacgagtgcggccaccacgccttcagcgactac

SEQ ID NO: 2180 - DNA, 349 bp, Artificial
  Mutation in BnaC.FAD2.b introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggaaacctcaagaaaacaatcccacctcactgcttcaaactctccatccctcgctccttctcctacctcctcttcgacatcctcgtcccctcctccctcgaccacctctccacagcctactcccctctcctcccccaccctcgcccgtaccttggccccactactgggcctgccaaggctgcggcctaacgggcctctgggacatcgcccacgaatgcggccaccacgccttcagcgactac

SEQ ID NO: 2181 - DNA, 349 bp, Artificial
  Mutation in BnaC.FAD2.b introduced by TALE nuclease pair BnFAD2_T01
caggatccatgggtgcaggtgaaagaatgcaagtgtctcctccctccaagaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 2182 - DNA, 356 bp, Artificial
  Mutation in BnaC.FAD2.b introduced by TALE nuclease pair BnFAD2_T01
caggatccatgggtgcaggtggaagaatgcaagtctcttctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacatcctacttccctctcctccccccccccctcccttacctcgccgcctggccccgctactgggcctgccaagggtgcctcctaaccggcgtctggggcatagcccacgagtgcggccaccacgccttcagcgactac

SEQ ID NO: 2183 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacatcactgcttcaaacgctccatccctcgctccttctcctacctcctcttcgacatcctcgtctcctcctccctctaccacctctccacagcctacttccctctcctccctcaccctctctcctactggcctctctactgggcctgccaaggctgcgtcctaacgggcctctgggtcatagcccacgagtgcggccaccacgccttcagcgactac

SEQ ID NO: 2184 - DNA, 358 bp, Artificial
  Mutation in BnaC.FAD2.b introduced by TALE nuclease pair BnFAD2_T01
caggatccatgggtgcaggtggaagaatgcaagtctatcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctcgtctggcccctctactgggcctgccaaggctgcgtcctaacgggcctctgggtcatcgcccacgaatgcggccaccacgccttcagcgactac

SEQ ID NO: 2185 - DNA, 400 bp, Artificial
  Mutation in BnaC.FAD2.b introduced by TALE nuclease pair BnFAD2_T01
caggatccatgggtgcaggtggaagaatgcaagtctctcctccctccagctcccccggaaccaaaaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttcccttgcctcgggcatccaagcagcaagcgcgttacgccgtgggtcgatgtttgactggcccctctactgggcctgccaaggctgcgtcctaacgggcctctgggtcatcgcccacgaatgcggccaccacgccttcagcgacta

SEQ ID NO: 2186 - DNA, 352 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatcccacgctccttctcctacctcctcttcgacatcctcgtctcctcctccctctaccacctctccacagcctacttccctctcctcccccaccctctcccttacctcgctggcccctctactgggcctgccaaggctgcgtcctaacgggcctctgggtcatcgcccacgaatgcggccaccacgccttcagcgactac

SEQ ID NO: 2187 - DNA, 340 bp, Artificial
  Mutation in BnaC.FAD2.b introduced by TALE nuclease pair BnFAD2_T01
caggatccatgggtgcaggtggaataatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctccctctactgggcctgccaaggctgcgtcctaacgggcctctgggtcatcgcccacgaatgcggccaccacgccttcagcgactac

SEQ ID NO: 2188 - DNA, 348 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttggcctctctactgggcctgccaagggtgcgtcctaaccggcgtctgggtcatagcccacgagcgcggccaccacgccttcagcgactac

SEQ ID NO: 2189 - DNA, 336 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtccccagcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctgggcctgccaaggctgcgtcctaacgggcctctgggtcatcgcccacgaatgcggccaccacgccttcagcgactac

SEQ ID NO: 2190 - DNA, 345 bp, Artificial
  Mutation in BnaC.FAD2.b introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgctccctcgctccttctcctacctcctcttcgacatcctcgtctcctcctccctctaccacctctccacagcctacttccctctcctcccccacactctcccttaaggcccctctactgggcctgccaaggctgcgtcctaacgggcctctgggtcatcgcccacgagtgcggccaccacgccttcagcgctac

SEQ ID NO: 2191 - DNA, 344 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccccctctactgggcctgccaaggctgcgtcctaacgggcctctgggtcatcgcccacgaatgcggccaccacgccttcagcgactac

SEQ ID NO: 2192 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacccctctactgggcctgccaaggctgcgtcctaacgggcctctgggtcatagcccacgagtgcggccaccacgccttcagcgactac

SEQ ID NO: 2193 - DNA, 353 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctccccccccaccctcccccttacctcgcctggccctctactgggcctgccaaggctgcgtcctaacgtgcctctgggtcatcgcccacgaatgctgccaccacgccttcagcgactac

SEQ ID NO: 2194 - DNA, 337 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctccctctaccacctctccacagcctacttccctctcctcccccaccctctcccttggcccctctactgggcctgccaaggctgcgtcctaacgggcctctgggtcatcgcccacgaatgcggccaccacgccttcagcgactac

SEQ ID NO: 2195 - DNA, 348 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttgcctcgcccctctactgggcctgccaaggctgcgtcctaacgggcctctgggtcatcgcccacgaatgcggccaccacgccttcagcgactac

SEQ ID NO: 2196 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccctctactgggcctgccaaggctgcgtcctaacgggcctctgggtcatcgcccacgaatgcggccaccacgccttcagcgactac

SEQ ID NO: 2197 - DNA, 357 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgccacctggcccctctactgggcctgccaaggctgcgtcctaacgggcctctgggtcatcgcccacgaatgcggccaccacgccttcagcgactac

SEQ ID NO: 2198 - DNA, 340 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccacccgctccctccctctactgggcctgccaaggctgcgtcctaacgggcctctgggtcatcgcccacgaatgcggccaccacgccttcagcgactac

SEQ ID NO: 2199 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatagcccacgagtgcggccaccatgccttcagcgactac

SEQ ID NO: 2200 - DNA, 340 bp, Artificial
  Mutation in BnaC.FAD2.b introduced by TALE nuclease pair BnFAD2_T01
caggatccatgggtgcaggtggaagaatgcaagtgtctcctccctccagctcccccggaaccaacgccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccacccgcctggcccctctactgggcctgccaaggctgcgtcctaacgggcctctgggtcatcgcccacgaatgcggccaccacgccttcagcgactac

SEQ ID NO: 2201 - DNA, 340 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctccctctactgggcctgccaaggctgcgtcctaacgggcctctgggtcatcgcccacgaatgcggccaccacgccttcagcgactac

SEQ ID NO: 2202 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccatcaagcgcgtaccctgcgagacaccgcccttcactgtcggagaactcaagaaagcaatcccaccgcactgtttcaaacgctccatccctcgctccttctcctacctcctcttcgacatcctcgtctcctcctccctctaccacctctccacagcctacttccctctcctcccccaccctctctcctactggcctctctactgggcctgccagggctgcgtcctaaccggcgtctgggtcatagcccacgagtgcggccaccacgccttcagcgactac

SEQ ID NO: 2203 - DNA, 337 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatcccacgctccttctcctcttcgacatcatcatctcctcctcggctcctccctctaccacctctccacagcctacttccctctcctcccccaccctctcccttacctgggcctgccaaggctgcgtcctaacgggcctctgggtcatcgcccacgaatgcggccaccacgccttcagcgactac

SEQ ID NO: 2204 - DNA, 337 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctcgcccctctactgggcctgccaaggctgcgtcctaacgggcctccgggtcatcgcccacgaatgcggccaccacgccttcagcgactac

SEQ ID NO: 2205 - DNA, 324 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttcgcctggcctctctactgggcctgccaagggtgcgtcctaaccggcgtctgggtcatagcccacgagtgcgtccaccacgccttcagcgactac

SEQ ID NO: 2206 - DNA, 331 bp, Artificial
  Mutation in BnaC.FAD2.b introduced by TALE nuclease pair BnFAD2_T01
caggatccatgggtgcaggtggaagaatgcaagtgtctcctcactccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctccctggcccctctactgggcctgccaaggctgcgtcctaacgggcctctgggtcatcgcccacgaatgcggccaccgcgccttcagcgactac

SEQ ID NO: 2207 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgtttcaaacgctccatccctcgctccttctcctacctcctcttcgacatcctcgtctcctcctccctctaccacctctccacagcctacttccctctcctcccccaccctctcccttacctcgccctggcccctctactgggcctgccaaggctgcgtcctaacgggcctctgggtcatcgcccacgaatgcggccaccacgccttcagcgactac

SEQ ID NO: 2208 - DNA, 331 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctggcccctctactgggcctgccaaggctgcgtcctaacgggcctctgtgtcatcgcccacgaatgcggccaccacgccttcagtgactac

SEQ ID NO: 2209 - DNA, 312 bp, Artificial
  Mutation in BnaC.FAD2.b introduced by TALE nuclease pair BnFAD2_T01
caggatccatgggtgcaggtggaagaatgcaagtgtctcctccctccagctcccccggaaccaacaccctcaaacgcgtcccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctgggtctgccaaggctgcgtcctaacgggcctctgggtcatcgcccacgaatgcggccaccacgccttcagcgactac

SEQ ID NO: 2210 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctcttcgacatcatcatctcctcctccctctaccacctctccacagcctacttccctctcctccccccccctctcccttacctctggcccctctactgggcctgccaaggctgcgtcctaacgggcctctgggtcatagcccacgagtgcggccaccacgccttcagcgactac

SEQ ID NO: 2211 - DNA, 348 bp, Artificial
  Mutation in BnaC.FAD2.b introduced by TALE nuclease pair BnFAD2_T01
caggatccatgggtgcatgtggaagaatgcaagtctctcctccctccagctccctcggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcctctctactgggcctgccaagggtgcgtcctaaccggcgtctgggtcatagcccacgagtgcggccaccacgccttcagcgactac

SEQ ID NO: 2212 - DNA, 401 bp, Artificial
  Mutation in BnaC.FAD2.b introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttgcctcgggcatccaagcagcaagcgcgttacgccgtgtgtcgatgtttgactggcccctctactgggcctgccaaggctgcgtcctaacgggcctctgggtcatcgcctacgaatgcggccaccacgccttcagcgactac

SEQ ID NO: 2213 - DNA, 345 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctaggcctctctactgggcctgccaaggctgcgtcctaacgggcctctgggtcatagcccacgagtgcggccaccacgccttcagcgactac

SEQ ID NO: 2214 - DNA, 341 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaaacgcgtcccctgcgagacaccaccattcactctcggagacctcaagaaagcaatcccacctcactgcttcaaacgctccatccctcgctccttctcctacctcctcttcgacatcctcgtctccacctccctctaccacctctccacagcctacttccctctcctcccccaccctcccccctccctctactgggcctgccaaggctgcgtcctaacgggcctctgggtcatcgcccacgaatgcggccaccacgccttcagcgactac

SEQ ID NO: 2215 - DNA, 350 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctctggcccctctactgggcctgccaaggctgcgtcctaacgggcctctgggtcatcgcccacgaatgcggccaccacgccttcagcgactac

SEQ ID NO: 2216 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgtgagacaccaccctccactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 2217 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcatcatctcctcctccctctaccacctctccacagccacgatggcggcaagcaggcgctggagcctggcccctctactgggcctgccaaggctgcgtcctaacgggcctctgggtcatcgcccacgaatgcggccaccacgccttcagcgactac

SEQ ID NO: 2218 - DNA, 387 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacaacggctgataggatcccccaatccctttttcactgcatctggcccctctactgggcctgccaaggctgcgtcctaacgggcctctgggtcatcgcccacgagtgcggccaccacgccttcagcgactac

SEQ ID NO: 2219 - DNA, 352 bp, Artificial
  Mutation in BnaC.FAD2.b introduced by TALE nuclease pair BnFAD2_T01
catgatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgctggcccctctactgggcctgccaaggctgcgtcctaacgggcctctgggtcatcgcccacgaatgcggccaccacgccttcagcgactac

SEQ ID NO: 2220 - DNA, 348 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatcccacgctccttctcctcttcgacatcatcatctcctcctcggctcctccctctaccacctctccacagcctacttccctctcctccccccccctctccctagcctgcccctctactgggcctgccaaggctgcgtcctaacgggcctctgggtcatcgcccacgaatgcggccaccacgccttcagcgactac

SEQ ID NO: 2221 - DNA, 337 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaacctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccccctctactgggcctgccaaggctgcgtcctaacgggcctctgggtcatcgcccacgaatgcggccaccacgccttcagcgactac

SEQ ID NO: 2222 - DNA, 353 bp, Artificial
  Mutation in BnaC.FAD2.b introduced by TALE nuclease pair BnFAD2_T01
caggatccatgggtcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctccgcctggcccctctactgggcctgccaaggctgcgtcctaacgggcctctgggtcatcgcccacgaatgcggccaccacgccttcagcgactac

SEQ ID NO: 2223 - DNA, 468 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttgccgtgaggggtcaagccgggggcctggcacagcaccggcaacagcgcctgcaacttgtgtatacaaagttgttgcatgcaggcctctgcaggggcaagcacctgggcggctccaggaagccctggcccctctactgggcctgccaaggctgcgtcctaacgggcctctgggtcatcgcccacgaatgcggcctccacgccttcagcgactac

SEQ ID NO: 2224 - DNA, 348 bp, Artificial
  Mutation in BnaC.FAD2.b introduced by TALE nuclease pair BnFAD2_T01
caggatccatgggtgcaggtggaagaatgcaagtctctcctccctcaagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggccttcctaggctgcgtcctaacgggcctctgggtcatcgcccacgtatgcggccaccacgccatcagcgactac

SEQ ID NO: 2225 - DNA, 337 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttacctcctgacccctctactgggcctgccaaggctgcgtcctaacgggcctctgggtcatcgcccacgaatgcggccaccacgccttcagcgactac

SEQ ID NO: 2226 - DNA, 346 bp, Artificial
  Mutation in BnaC.FAD2.b introduced by TALE nuclease pair BnFAD2_T01
caggatccatgggtgcaggtagaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctccctctactggtcctgccaaggctgcgtcctaacgggcctctgggtcatcgcccacgaatgcggccaccacgccttcagcgactac

SEQ ID NO: 2227 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccgtacctcccctctactgggcctgccaaggctgcggcctaacgggcctctgggtcatcgcccacgaatgcggccaccacgccttcagcgactac

SEQ ID NO: 2228 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctcccctcccccaccccctcccttcccttggcccctctactgggcctgccaaggctgcgtcctaacgggcctctgggtcatcgtccacgagtgcggccaccacgccttcagcgactac

SEQ ID NO: 2229 - DNA, 342 bp, Artificial
  Mutation in BnaC.FAD2.b introduced by TALE nuclease pair BnFAD2_T01
caggatccatgggtgcaggtggaagaatgcaagtctctactccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctcgcctcccccaccctctcccttaccctctactgggccggccaaggctgcgtcctaacgggcctctgggtcatagcccacgagtgcggccaccacgccttcagcgactac

SEQ ID NO: 2230 - DNA, 401 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctcccccttaccctgcctcgggcatccaagcagcaagcgcgttacgccgtgggtcgatgtttgactggcccctctactgggcctgccaagggggcggcctaaccggcgtctgggtcatagcccacgagggcggccaccacgccttcatcgactac

SEQ ID NO: 2231 - DNA, 347 bp, Artificial
  Mutation in BnaC.FAD2.b introduced by TALE nuclease pair BnFAD2_T01
caggatccatgggtgcaggtggaagaatgcaagtctctactccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctaacctgcccctctactgggcctgccaaggctgcgtcctaacgggcctctgggtcatcgcccacgaatgcggccaccacgccttcagcgactac

SEQ ID NO: 2232 - DNA, 357 bp, Artificial
  Mutation in BnaC.FAD2.b introduced by TALE nuclease pair BnFAD2_T01
caggtccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctcgtctggcccctctactgggcctgccaaggctgcgtcctaacgggcctctgggtcatagcccacgagtgcggccaccacgccttcagcgactac

SEQ ID NO: 2233 - DNA, 316 bp, Artificial
  Mutation in BnaC.FAD2.b introduced by TALE nuclease pair BnFAD2_T01
caggatccatgggtgcaggttgaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctcaccctctctcctacttcgctggcctctctactgggcctgccagggctgcgtcctaaccggcgtctgggtcatagcccacgagtgcggccaccacgccttcagcgactac

SEQ ID NO: 2234 - DNA, 356 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactctcggagacctcaagaaagcaatcccacctcactgcttcaaacgctacatcccacgctccttctcctcttcgacatcatcatctcctcctcggctcctccctctaccacctctccacagcctacttccctctcctcccccaccctctcccttacctccttcctggcccctctactgggcctgccaaggctgcgtcctaacgggcctctgggtcatcgcccacgaatgcggccaccacgccttcagcgactac

SEQ ID NO: 2235 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaagcgctccatcccacgctccttctcctacctcctcttcgacatcctcgtctcctcctccctctaccacctctccacagcctacttccctctcctcccccaccctctcccttacctcccctctactgggcctgccaaggctgcgtcctaacgggcctctgggtcatcgcccacgaatgcggccaccacgccttcagcgactac

SEQ ID NO: 2236 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacatcactgcttcaaacgctccatcccacgctccttctcctcttcgacatcatcatctcctcctcggctcctccctctaccacctctccacagcctacttccctctcctcccccaccctctcccttacccctctactgggcctgccagggctgcgtcctaaccggcgtctgggtcatagcccacgagtgcggccaccacgccttcagcgactac

SEQ ID NO: 2237 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctctgtctctctactgggcctgccaagggtgcgtcctaacgggcctctgggtcatagcccacgagtgcggccaccacgccttcagcgactac

SEQ ID NO: 2238 - DNA, 345 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatagcctcctgcttctactacgtcgccaccacttacttccctctcctccctcaccctctctcctaccgccctggcctctctactgggcctgccagggctgcgtcctaaccggcgtctgggtcatagcccacgagtgcggccaccacgccttcagcgactac

SEQ ID NO: 2239 - DNA, 261 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgcttcaaacgctccatcccacgctccttctcctcttcgacatcatcatctcctcctcggctcctccctctaccacctctccacagcctacttccctctcccttaccacgccttcagcgactac

SEQ ID NO: 2240 - DNA, 402 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatcccacgctccttctcctcttcgacatcatcatctcctcctcggctcctccctctaccacctctccacagcctacttccctctcctcccccaccctcccccttaccttgcctcgggcatccaagcagcaagcgcgttacgccgtgggtcgatgtttgactggcccctctactgggcctgccaaggctgcgtcctaacgggcgtctgggtcatagcccacgattgcggccaccacgccttcagctactac

SEQ ID NO: 2241 - DNA, 344 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatcttcgacatcctcgtctcctcctccctctaccacctctccacagcctacttccctctcctcccccaccctctcccttggcccctctactgggcctgccaaggctgcgtcctaacgggcctctgggtcatcgcccacgaatgcggccaccacgccttcagcgactac

SEQ ID NO: 2242 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctctgacccctctactgggcctgccaaggctgcgtcctaacgggcctctgggtcatagcccacgagtgcggccaccacgccttcagcgactac

SEQ ID NO: 2243 - DNA, 350 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacccctggcccctctactgggcctgccaaggctgcgtcctaacgggcctctgggtcatcgcccacgaatgcggccaccacgccttcagcgactac

SEQ ID NO: 2244 - DNA, 261 bp, Artificial
  Mutation in BnaC.FAD2.b introduced by TALE nuclease pair BnFAD2_T01
caggatccattggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttaccacgccttcagcgactac

SEQ ID NO: 2245 - DNA, 300 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtctctctactgggcctgccaagggtgcgtcctaacgggcctctgggtcatagcccacgagtgcggccaccacgccttcagcgactac

SEQ ID NO: 2246 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttgggcctctctactgggcctgccaagggtgcgtcctaacgggcctctgggtcatagcccacgagtgcggccaccacgccttcagcgactac

SEQ ID NO: 2247 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcgtcctaaccggcgtctgggtcatagcccacgagtgcggccaccacgccttcagcgactac

SEQ ID NO: 2248 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcggcccctctactgggcctgccaaggctgcgtcctaacgggcctctgggtcatcgcccacgaatgcggccaccacgccttcagcgactac

SEQ ID NO: 2249 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctcccccttacctcgcccctctactgggcctgccaaggctgcgtcctaacgggcctctgggtcatcgcccacgaatgcggccaccacgccttcagcgactac

SEQ ID NO: 2250 - DNA, 356 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctcgccgcctggcccctctactgggcctgccaaggctgcgtcctaacgggcctctgggtcatcgcccacgaatgcggccaccacgccttcagcgactac

SEQ ID NO: 2251 - DNA, 353 bp, Artificial
  Mutation in BnaC.FAD2.b introduced by TALE nuclease pair BnFAD2_T01
caggatccatgggtgcaggtggaagaatgcaagtctctcctccatccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctcgcccttacctcgccctggcccctctactgggcctgccaaggctgcgtcctaacgggcctctgggtcatcgcccacgaatgcggccgccacgccttagcgactac

SEQ ID NO: 2252 - DNA, 350 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatcccacgctccttctcctcttcgacatcatcatctcctcctcggctcctccctctaccacctctccacagcctacttccctctccccccccaccctctcccttcccttggcccctctactgggcctgccaaggctgcgtcctaacgggcctctgggtcatcgcccacgaatgcggccaccacgccttcagcgactac

SEQ ID NO: 2253 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaagagtgcggcctaaccggcgtctgggtcatagcccacgagtgcggccaccacgccttcagcgactac

SEQ ID NO: 2254 - DNA, 346 bp, Artificial
  Mutation in BnaC.FAD2.b introduced by TALE nuclease pair BnFAD2_T01
caggatccatgggtgcaggtggaagaatgcaagtctctactccctccagctcccccggaaccaacaccctcaaacgcgtcccctgcgagacaccaccattcactctcggagaactcaagaaagcaatcccaccgcactgtttcaaacgctcgatccctcgctctttctcctacctcatctgggacatcatcatagcctcctgcttctactacgtcgccaccacttacttccctctcctccccccccctctcccttccctcgcctctactgggcctgccaaggctgcgtcctaacgggcctctgggtcatcgcccacgaatgcggccaccacgccttcagcgactac

SEQ ID NO: 2255 - DNA, 349 bp, Artificial
  Mutation in BnaC.FAD2.b introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcggccaccacgccatcagcgactac

SEQ ID NO: 2256 - DNA, 347 bp, Artificial
  Mutation in BnaC.FAD2.b introduced by TALE nuclease pair BnFAD2_T01
caggatccatgggtgcagctggaagaatgcaagtatctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctactcgcctctctactgggcctgccagggctgcgtcctaaccggcgtctgggtcatagcccacgagtgcggccaccacgccttcagcgactac

SEQ ID NO: 2257 - DNA, 356 bp, Artificial
  Mutation in BnaC.FAD2.b introduced by TALE nuclease pair BnFAD2_T01
caggatccatgggtgcaggtggaagaatgcaagtttctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccgcctggcccctctactgggccggccaaggctgcgtcctaacgggcctctgggtcatcgcccacgagtgcggccaccacgccttcagcgactac

SEQ ID NO: 2258 - DNA, 350 bp, Artificial
  Mutation in BnaC.FAD2.b introduced by TALE nuclease pair BnFAD2_T01
caggatccatgggtgcaggtggaagaatgcaagtctctactccctcaagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctggcccctctactgggcctgccaaggctgcttcctaacgggcctctgggtcatcgcccacgaatgcggccaccacgccttcagcgactac

SEQ ID NO: 2259 - DNA, 387 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgccattcactctcggagacctcaagaaagcaatcccacctcactgcttcaaacgctccatcccacgctccttctcctcttcgacatcctcgtctcctcctccctctaccacctctccacagcctacttccctctcctcccccaccctctcccttacctctaagggcgagatccggtgcagattatttggattgagagtgaatattgcccctctactgggcctgccaaggctgcgtcctaacgggcctctgggtcatagcccacgagtgcggccaccacgccttcagcgactac

SEQ ID NO: 2260 - DNA, 346 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctgccctctactgggcctgccaaggctgcgtcctaacgggcctctgggtcatcgcccacgaatgcggccaccacgccttcagcgactac

SEQ ID NO: 2261 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctactttggcctctctactgggcctgccagggctgcgtcctaaccggcgtctgggtcatagcccacgagtgcggccaccacgcctgcagcgactac

SEQ ID NO: 2262 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccgaacccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctcccccttacccctctactgggcctgccaaggctgcgtcctaacgggcctctgggtcatcgcccacgaatgcggccaccacgccttcagcgactac

SEQ ID NO: 2263 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccgcccgctcccttgcctcccctctgctgggcctgccaaggctgcgtcctaacgggcctctgggtcatcgcccacgaatgcggccaccacgccttcagcgactgc

SEQ ID NO: 2264 - DNA, 348 bp, Artificial
  Mutation in BnaC.FAD2.b introduced by TALE nuclease pair BnFAD2_T01
caggatccatgggtgcaggtggaagaatgcaagtctctcctcactccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 2265 - DNA, 348 bp, Artificial
  Mutation in BnaC.FAD2.b introduced by TALE nuclease pair BnFAD2_T01
caggatccatgggtgcagggggaagaatgcaagtgtctagtccctccaaaaagtctgaaaccgacaacatcaagcgcgtaccctgcgagacaccgcccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctcccctacttggcctctctactgggcctgccaagggtgcgtcctaaccggcgtctgggtcatagcccacgagtgcggccaccacgccttcagcgactac

SEQ ID NO: 2266 - DNA, 343 bp, Artificial
  Mutation in BnaC.FAD2.b introduced by TALE nuclease pair BnFAD2_T01
caggatccatgagtgcaggtgaaagaatgcaagtctctaatccctccagctcccccgaaaccaaaaccatcaagcgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacccctctactgggcctgccaaggctgcgtccgaacgtgcctctgggtcatcgcccacgaatgcggccaccacgccatcagcgactac

SEQ ID NO: 2267 - DNA, 343 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctccccccccctctcccttacctctggcccctctactgggcctgccaaggctgcgtcctaacgggcctctgggtcatcgcccacgaatgcggccaccacgccttcagcgactac

SEQ ID NO: 2268 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctcccccttaccttggcccctctactgggcctgccaaggctgcgtcctaacgggcctctgggtcatcgcccacgaatgcggccaccacgccttcagcgactac

SEQ ID NO: 2269 - DNA, 343 bp, Artificial
  Mutation in BnaC.FAD2.b introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacccctctactgggcctgccaaggctgcgtcctaacgggcctctgggtcatcgcccacgaatgcggccaccacgccttcagcgactac

SEQ ID NO: 2270 - DNA, 342 bp, Artificial
  Mutation in BnaC.FAD2.b introduced by TALE nuclease pair BnFAD2_T01
caggatccatgggtgcaggtggaagaatgcaagtctctactccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctctactgggcctgccaaggctgcgtcctaacgggcctctgggtcatcgtccacgaatgcggccaccacgccttcagcgactac

SEQ ID NO: 2271 - DNA, 355 bp, Artificial
  Mutation in BnaC.FAD2.b introduced by TALE nuclease pair BnFAD2_T01
caggatccatgggtgcaggtggaagattgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacctccttcctggcccctctactgggcctgccaaggctgcgtcctaacgggcctctgggtcatagcccacgagtgcggccaccacgccttcagcgactac

SEQ ID NO: 2272 - DNA, 350 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctccatccctcgctccttctcctacctcctcttcgacatcctcgtctcctcctccctctaccacctctccacagcctacttccctctcctcccccaccctctccctctcccctggcccctctactgggcctgccaaggctgcgtcctaacgggcctctgggtcatagcccacgagtgcggccaccacgccttcagcgactac

SEQ ID NO: 2273 - DNA, 261 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctctttgacatcatcatctcctcctcggctcctccctctaccacctctccacagcctacttccctctcccttaccacgccttcagcgactac

SEQ ID NO: 2274 - DNA, 429 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctccagcggctgttgccggtgctgtgccaggcccacggcttgaccccggagcaggtggtggccatcgccagccacgatggtggcccctctactgggcctgccaaggctgcgtcctaacgggcctctgggtcatcgcccacgaatgcggccaccacgccttcagcgactac

SEQ ID NO: 2275 - DNA, 338 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatcccacgctccttctcctcttcgacatcatcatagcctcctgcttctactacgtcgccaccacttacttccctctcctccctcaccctctctcctacgcctctctactgggcctgccagggctgcgtcctaaccggcgtctgggtcatagcccacgagtgcggccaccacgccttcagcgactac

SEQ ID NO: 2276 - DNA, 337 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgcttcaaacgctccatccctcgctccttctcctacctcctcttcgacatcctcgtctcctcctccctctaccacctctccacagcctacttccctctcctccccccccctctcccctctactgggcctgccaaggctgcgtcctaacgggcctctgggtcatcgcccacgaatgcggccaccacgccttcagcgactac

SEQ ID NO: 2277 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctcccccaccctctcccttccctcgccctggcccctctactgggcctgccaaggctgcgtcctaacgggcctctgggtcatcgcccacgaatgcggccaccacgccttcagcgactac

SEQ ID NO: 2278 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttatggcccctctactgggcctgccaaggctgcgtcctaacgggcctctgggtcatagcccacgagtgcggccaccacgccttcagcgactac

SEQ ID NO: 2279 - DNA, 350 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacccctggcccctctactgggcctgccaaggctgcgtcctaacgggcctctgggtcatcgcccacgaatgcggccaccacgccttcagcgactac

SEQ ID NO: 2280 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttccctcgccctggcccctctactgggcctgccaaggctgcgtcctaacgggcctctgggtcatcgcccacgaatgcggccaccacgccttcagcgactac

SEQ ID NO: 2281 - DNA, 337 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctccacttcgacatcctcctctcctcctccctctaccacctctccacagcctacttccctcacccttaccccgcctacccctctactgggcctgccaaggctgcgtcctaacgggcctctgggtcatagcccacgagtgcggccaccacgccttcagcgactac

SEQ ID NO: 2282 - DNA, 349 bp, Artificial
  Mutation in BnaC.FAD2.b introduced by TALE nuclease pair BnFAD2_T01
caggatccatgggtgcaggtggaagaatgcaagtctctcctccatccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcatccctctaccacctctccacagcctacttccctctcctccctcaccctctctcctactttggcctctctactgggcctgccagggctgcgtcctaaccggcgtctgggtcatagcccacgagtgcggccaccacgccttcagcgactac

SEQ ID NO: 2283 - DNA, 413 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgctggagacggtccagcggctgttgccggtgctgtgccaggcccacggcttgaccccggagctggcccctctactgggcctgccaaggctgcgtcctaacgggcctctgggtcatagcccacgagtgcggccaccacgccttcagcgactac

SEQ ID NO: 2284 - DNA, 261 bp, Artificial
  Mutation in BnaC.FAD2.b introduced by TALE nuclease pair BnFAD2_T01
caggatcaatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttaccacgccttcagcgactac

SEQ ID NO: 2285 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttcccttggcccctctactgggcctgccaaggctgcgtcctaacgggcctctgggtcatagcccacgagtgcggccaccacgccttcagcgactac

SEQ ID NO: 2286 - DNA, 387 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacaacggctgataggatcccccaatccctttttcactgcatctggcccctctactgggcctgccaaggctgcgtcctaacgggcctctgggtcatcgcccacgaatgcggccaccacgccttcagcgactac

SEQ ID NO: 2287 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccgtaccttggcccctctactgggcctgccaaggctgcgtcctaacgggcctctgggtcatcgcccacgaatgcggccaccacgccgtcagcgactac

SEQ ID NO: 2288 - DNA, 348 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaaacgcgtcccctgcgagacaccacccttcactctcggagacctcaagaaagcaatcccacctcactgcttaaaacgctccatccctcgctccttctcctacctcctcttcgacatcctcgtctcctcctccctctaccacctctccacagcctacttccctctcctcccccaccctctcccttacctcgcccctctactgggcctgccaaggctgcgtcctaacgggcctctgggtcatcgcccacgaatgcggccaccacgccttcagcgactac

SEQ ID NO: 2289 - DNA, 331 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctccctggcccctctactgggcctgccaaggctgcgtcctaacgggcctctgggtcatcgcccacgaatgcggccaccacgccttcagcgactac

SEQ ID NO: 2290 - DNA, 336 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctccctttcctgggcctgccaaggctgcgtcctaacgggcctctgggtcatcgcccacgaatgcggccaccacgccttcagcgactac

SEQ ID NO: 2291 - DNA, 349 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaaactcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcggcctctctactgggcctgccaagggtgcgtcctaaccggcgtctgggtcatagcccacgagtgcggccaccacgccttcagcgactac

SEQ ID NO: 2292 - DNA, 350 bp, Artificial
  Mutation in BnaC.FAD2.b introduced by TALE nuclease pair BnFAD2_T01
caggatccatgggtgcaggtggaagaatgcaagtgtctcctccctccagcaaacacgaaaccaaaaccctcaaacgcgtaaaatgcgagacaccaaaattcactctcggagaccacaagaaagcaatcccacctcactgcttcaaacgttccatccctcgctccttctcctacctcctcttcgacatccacgtctcctccaccctctaccacctctccacagcctacttccctctcctccccccccctctcccttacctctggcccctctactgggcctgccaaggctgcgtcctaacgggcctctgggtcatcgcccacgaatgcggccaccacgccttcagcgactac

SEQ ID NO: 2293 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctggccctctactgggcctgccaaggctgcgtcctaacgggcctctgggtcatcgcccacgaatgctgccaccacgccttcagcgactac

SEQ ID NO: 2294 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccctctactgggccggccaaggctgcgtccgcacgggcctctgggtcatcgcccacgaatgcggccaccacgccttcagcgactac

SEQ ID NO: 2295 - DNA, 341 bp, Artificial
  Mutation in BnaC.FAD2.b introduced by TALE nuclease pair BnFAD2_T01
caggatccatgggtgcaggtggaagaatgcaagtgtctcctccatccaaaaagtctgaaaccgacaacatcaagcgcgtaccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctactgggcctgccaaggctgcgtcctaacgggcctctgggtcatcgcccacgaatgcggccaccacgccttcagcgactac

SEQ ID NO: 2296 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctactttggcctctctactgggcctgccaagggtgcgtcctaaccggcgtctgggtcatagcccacgagtgcggccaccacgccttcagcgactac

SEQ ID NO: 2297 - DNA, 335 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctactgggcctgccagggctgcgtcctaaccggcgtctgggtcatagcccacgagtgcggccaccacgccttcagcgactac

SEQ ID NO: 2298 - DNA, 332 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccgcctctccacagcctacttccctctcctccctcaccctctctactgggcctgccaagggtgcgtcctaaccggcgtctgggtcatagcccacgagtgcggccaccacgccttcagcgactac

SEQ ID NO: 2299 - DNA, 345 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccctccctccctctactgggcctgccaaggctgcgtcctaacgggcctctgggtcatcgcccacgaatgcggccaccacgccttcagcgactac

SEQ ID NO: 2300 - DNA, 353 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccccccccctctcccttaccacgcctggccctctacggggcctgccaagggtgcgtcctaacgggcctctgggtcatagcccacgagtgcggccaccacgccttcagcgactac

SEQ ID NO: 2301 - DNA, 349 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcatacttccctctcctcccccacccgctcccttacctgggccccgcaactgggcctgccaaggctgcgtcctaacgggcctctgggtcatcgcccgcgaatgcggccacctcgccttcagcgactac

SEQ ID NO: 2302 - DNA, 349 bp, Artificial
  Mutation in BnaC.FAD2.b introduced by TALE nuclease pair BnFAD2_T01
caggatccattggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctacggggcctgccaaggctgcgtcctaacgggcctctgggtcatcgcccacgaatgcggccaccacgccttcagcgactac

SEQ ID NO: 2303 - DNA, 349 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 2304 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcccctctactgggcctgccaaggctgcgtcctaacgggcctctgggtcatagcccacgagtgcggccaccacgccttcagcgactac

SEQ ID NO: 2305 - DNA, 352 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttccccccccggcccccctactgggcctgccaaggctgcgtcctaacgggcctctgggtcatcgcccacgaatgcggccaccacgccttcagcgactac

SEQ ID NO: 2306 - DNA, 340 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttccctctcccttacctcgccctggcccctctactgggccggccaaggctgcgtcctaacgggcctctgggtcatcgcccacgaatgcggccaccacgccttcagcgactac

SEQ ID NO: 2307 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctctggcccctctactgggcctgccaaggctgcgtcctaacgggcctctgggtcatagcccacgaatgcggccaccacgccttcagcgactac

SEQ ID NO: 2308 - DNA, 326 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcccacttccctctcctccccctctactgggcctgccaaggctgcgtcctaacgggcctctgggtcatcgcccacgaatgcggccaccacgccttcagcgactac

SEQ ID NO: 2309 - DNA, 304 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctcaccctctctggcctctctactgggcctgccaagggtgcgtcctaacgggcctctgggtcatagcccacgagtgcggccaccacgccttcagcgactac

SEQ ID NO: 2310 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgcttcaaacgctccatccctcgctccttctcctacctcctcttcgacatcctcgtctcctcctccctctaccacctctccacagcctacttccctctcctcccccaccctctcccttacctcgccggcccctctactgggcctgccaaggctgcgtcctaacgggcctctgggtcatcgcccacgaatgcggccaccacgccttcagcgactac

SEQ ID NO: 2311 - DNA, 337 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccctctactgggcctgccaaggctgcgtcctaacgggcctctgggtcatcgcccacgaatgcggccaccacgccttcagcgactac

SEQ ID NO: 2312 - DNA, 332 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatagcctcctgcttctactacgtcgccaccacttacttccctctcctccctcaccctctctcctacttactgggcctgccagggctgcgtcctaaccggcgtctgggtcatagcccacgagtgcggccaccacgccttcagcgactac

SEQ ID NO: 2313 - DNA, 261 bp, Artificial
  Mutation in BnaC.FAD2.b introduced by TALE nuclease pair BnFAD2_T01
caggatccatgggtgcaggcggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttaccacgccttcagcgactac

SEQ ID NO: 2314 - DNA, 352 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagatagcaatcccacctcactgcttcaaacgctccatccctcgctccttctcctacctcctcttcgacatcctcgtctcctcctccctctaccacctctccacagcctacttccctctcctcccccaccctcccccttacctcgcctgcccctctactgggcctgccaaggctgcgtcctaacgggcctctgggtcatcgcccacgaatgcggccaccacgccttcagcgactac

SEQ ID NO: 2315 - DNA, 429 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctctccagcggctgttgccggtgctgtgccaggcccacggcttgaccccggagcaggtggtggccatcgccagccacgatggtggcccctctactgggcctgccaaggctgcgtcctaacgggcctctgggtcatcgcccacgaatgcggccaccacgccttcagcgactac

SEQ ID NO: 2316 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcccctctactgggcctgccaagactgcgtcctaacgggcctctgggtcatcgcccacgaatgcggccaccacgccttcagcgactac

SEQ ID NO: 2317 - DNA, 352 bp, Artificial
  Mutation in BnaC.FAD2.b introduced by TALE nuclease pair BnFAD2_T01
caggatccatgggtgcaggtgcaagaatgcaagtctcttctcactccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccggcccctctactgggcctgccaaggctgcgtcctaacgggcctctgggtcatagcccacgagtgcgtccaccacgcctgcagcgactac

SEQ ID NO: 2318 - DNA, 396 bp, Artificial
  Mutation in BnaC.FAD2.b introduced by TALE nuclease pair BnFAD2_T01
caggatccatgtgggtggaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcctcgtctcctcctccctctaccacctctccacagcctacttccctctcctcccccaccctctcccttaccttgcctcgggcagccaagcagcaagcgcgttacgacgtgggtcgatgtttgactggcccctctactgggcctgccaaggctgcgtcctaacgggcctctgggtcatcgcccacgaatgcggccaccacgccttcagcgactac

SEQ ID NO: 2319 - DNA, 312 bp, Artificial
  Mutation in BnaC.FAD2.b introduced by TALE nuclease pair BnFAD2_T01
caggatccatgggtgcaggtgaaagaatgcaagtctcaactccctcaagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctgggtctgccaaggctgcgtcctaacgggcctctgggtcatcgcccgcgaatgcggccaccacgccttcagcgactac

SEQ ID NO: 2320 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttggcccctctactgggcctgccaaggctgcgtcctaacgggcctctgggtcatagcccacgagtgcggccaccacgccttcagcgactac

SEQ ID NO: 2321 - DNA, 341 bp, Artificial
  Mutation in BnaC.FAD2.b introduced by TALE nuclease pair BnFAD2_T01
caggatccatgggtgcaggtggaagaatgcaagtgtctactccctccaagaagtctgaaaccgacaccatccagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctctactgggcctgccaaggctgcgtcctaacgggcctctgggtcatcgcccacgaatgcggccaccacgccttcagtgactac

SEQ ID NO: 2322 - DNA, 434 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaccgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctcggctgttgccggtgctgtgccaggcccacggcttgaccccccagcaggtggtggccatcgacagcaatggcggtggcaagcaggcgctggaggcctggcctctctactgggccggccagggctgcgtcctaaccggcgtctgtgtcatagcccacgagtgcggccaccacgcctgcagcgactac

SEQ ID NO: 2323 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctcgcccttacccctctactgggcctgccaaggctgcgtcctaacgggcctctgggtcatcgcccacgaatgcggccaccacgccttcagcgactac

SEQ ID NO: 2324 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctggcctctctactgggcctgccaagggtgcgtcctaaccggcgtctgggtcatagcccacgagtgcggccaccacgccttcagcgactac

SEQ ID NO: 2325 - DNA, 334 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcccttaccttggcccctctactgggcctgccaaggctgcgtcctaacgggcctctgggtcatcgcccacgaatgcggccaccacgccttcagcgactac

SEQ ID NO: 2326 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctactttggcctctctactgggcctgccagggctgcgtcctaaccggcgtctgggtcatagcccacgagtgcggccaccacgccttcagcgactac

SEQ ID NO: 2327 - DNA, 405 bp, Artificial
  Mutation in BnaC.FAD2.b introduced by TALE nuclease pair BnFAD2_T01
caggatccatgggtgcaggtggaagaatgcaagtgtctcctccctccagctcccccgaaaccaacaccctcaaacgcgtcccctgcgagacaccaccattcactctcggagacctcaagaaagcaatcccacctcactgcttcaaacgctccatcccacgctccttctcctattacacatcctcctctcctcctccctccaccacctctccacagcctacttccctctcctccccccccccctcccttcccccgccggcgccgccccagcgcctgttgccggccccgcgccccgcccccgccctgaccccgcacctggcccctctactgggcctgccaagggtgcgtcctaaccggcgtctgggtcatcgcccacgagtgcggccaccacgccttcagcgactac

SEQ ID NO: 2328 - DNA, 331 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctggcccctctactgggcctgccagggctgcgtcctaacgggcctctgggtcatagcccacgagtgcggccaccacgccttcagcgactac

SEQ ID NO: 2329 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcgtccaccacgccttcagcgactac

SEQ ID NO: 2330 - DNA, 354 bp, Artificial
  Mutation in BnaC.FAD2.b introduced by TALE nuclease pair BnFAD2_T01
caggatccatgggtgcaggtggaagaatgcaagtctctcctccctccagctccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgccctggcccctctactgggcctgccaagggtgcgtcctaaccggcgtctgggtcatagcccacgagtgcggccaccacgccttcagcgactac

SEQ ID NO: 2331 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccccctcccgcacctgcccctctactgggcctgccaaggctgcgtcctaacgggcctctgggtcatcgcccacgaatgcggccaccacgccttcagcgactac

SEQ ID NO: 2332 - DNA, 421 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctccatccctcgctccttctcctacctcctcttcgacatcctcgtctcctcctccctctaccacctctccacagcctacttccctctcctccccccccctctcccttacctctggcaagcaggcgctggagccggtccagcggctgttgccggtgctgtgccaggcccacggcttgacccccctggcccctctactgggcctgccaaggctgcgtcctaacgggcctctgggtcatcgcccacgaatgcggccaccacgccttcagcgactac

SEQ ID NO: 2333 - DNA, 350 bp, Artificial
  Mutation in BnaC.FAD2.b introduced by TALE nuclease pair BnFAD2_T01
caggatccatgggtgcaggtggaagaatgcaagtgtctcctccccccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 2334 - DNA, 387 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctaccccggagcaggtggtggccatcgccagccacgatggcgcctggcctctctactgggcctgtcagggctgcgtcctaaccggcgtctgggtcatagcccacgagtgcggccaccacgccttcatcgactac

SEQ ID NO: 2335 - DNA, 334 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttacctggcccctctactgggcctgccaaggctgcgtcctaacgggcctctgggtcatcgcccacgaatgcggccaccacgccttcagcgactac

SEQ ID NO: 2336 - DNA, 326 bp, Artificial
  Mutation in BnaC.FAD2.b introduced by TALE nuclease pair BnFAD2_T01
caggatccatgggtgcaggtggaagaatgcaagtctctactccctccagctcccccgaaaccaaaacactcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccctctactgggcctgccaaggctgcgtcctaacgggcctctgggtcttcgcccacgagtgcggccaccaggccttcagtgactac

SEQ ID NO: 2337 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctcccctacttcgccctggcctctctactgggcctgccaagggtgcgtcctaacgggcctctgggtcatcgcccacgaatgcggccaccacgccttcagcgactac

SEQ ID NO: 2338 - DNA, 351 bp, Artificial
  Mutation in BnaC.FAD2.b introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctgcttctggcctctctactgggcctgccaagggtgcgtcctaaccggcgtctgggtcatagcccacgagtgcggccaccacgccttcagcgactac

SEQ ID NO: 2339 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgacttc

SEQ ID NO: 2340 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctccctctaccacctctccacagcctacttccctctcctcccccaccctctcccttacctcgcgcctggcccctctactgggcctgccaaggctgcgtcctaacgggcctctgggtcatcgcccacgaatgcggccaccacgccttcagcgactac

SEQ ID NO: 2341 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttcccttggcccctctactgggcctgccaaggctgcgtcctaacgggcctctgggtcatagcccacgagtgcggccaccacgccttcagcgactac

SEQ ID NO: 2342 - DNA, 349 bp, Artificial
  Mutation in BnaC.FAD2.b introduced by TALE nuclease pair BnFAD2_T01
caggatccatgggtgcaggtggaagaatgcaagtctctcctccctcaagctcccccgaaaccaaaaccctaaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccgccctctcccttaccttggcccctctactgggcctgccaaggctgcggccgaacgggcctctgggtcatcgcccacgaatgcggccaccacgccttcagcgactac

SEQ ID NO: 2343 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctccctcctcttcgccatcctcgtctcctcctccctccaccacccccccacagcctacttccctctcctccccccccctctccctcccctgacccctctactgggcctgccaaggctgcgtcctaacgggcctctgggtcatagcccacgagtgcggccaccacgccttcagcgactac

SEQ ID NO: 2344 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacggcctacttccctctcctcccccaccctcgcccttacctcgccctggcccctctactgggcctgccaaggctgcgtcctaacgggcctctgggtcatcgcccacgaatgcggccaccacgccttcagcgactac

SEQ ID NO: 2345 - DNA, 342 bp, Artificial
  Mutation in BnaC.FAD2.b introduced by TALE nuclease pair BnFAD2_T01
caggatccatgggtgcaggtggaagaatgcaagtctctcctccctccagctccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttaccctctactgggcctgccaaggctgcgtcctaacgggcctctgggtcatcgcccacgaatgcggccaccacgccttcagcgactac

SEQ ID NO: 2346 - DNA, 354 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctccgcctggcccctctactgggcctgccaaggctgcgtcctaacgggcctctgggtcatcgcccacgaatgcggccaccacgccttcagcgactac

SEQ ID NO: 2347 - DNA, 429 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccttgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctctccagcggctgttgccggtgctgtcccaggcccacggcttgacccctcagcaggtggtggccatcgccagccacgatggtggcccctctactgggcctgccaaggctgcgtcctaacgggcctctgggtcatcgcccacgaatgcggccaccacgccttcagcgactac

SEQ ID NO: 2348 - DNA, 324 bp, Artificial
  Mutation in BnaC.FAD2.b introduced by TALE nuclease pair BnFAD2_T01
caggatccatgggtgcaggtggaagaatgcaagtctctcctccttccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttcgcctggcctctctactgggcctgccaagggtgcgtcctaaccggcgtctgggtcatagcccacgagtgcggccaccacgccttcagcgactac

SEQ ID NO: 2349 - DNA, 297 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctcaccctctctctactgggcctgccaagggtgcgtcctaaccggcgtctgggtcatagcccacgagtgcggccaccacgcctgcagcgactac

SEQ ID NO: 2350 - DNA, 401 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttgcctcgggcatccaagcagcaagcgcgttacgccgtgggtcgatgtttgactggcccctctactgggcctgccaaggctgcgtcctaacgggcctctgggtcatcgcccacgaatgcggccaccacgccttcagcgactac

SEQ ID NO: 2351 - DNA, 316 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctccctcaccctctctcctacttcgccgcctggcctctctactgggcctgccaagggtgcgtcctaaccggcgtctgggtcatagcccacgagtgcggccaccacgccttcagcgactac

SEQ ID NO: 2352 - DNA, 429 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaccgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctcccccttaccgctccagcggatgttgccggtgctgtgccaggcgcgcggcgtgaccactcagcaggtggtggccatcgccagccacgatggtggcccctctactgggccggccaaggctgcgtcctaacgggcctctgggtcagcgcccacgaaggcggccaccacgccttcagcgactac

SEQ ID NO: 2353 - DNA, 348 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 2354 - DNA, 343 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatcccacgctccttctcctcttcgacatcatcatctcctcctccctctaccacctctccacagcctacttccctctcctccccccccctctcccttacccctggcccctctactgggcctgccaaggctgcgtcctaacgggcctctgggtcatcgcccacgaatgcggccaccacgccttcagcgactac

SEQ ID NO: 2355 - DNA, 312 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctgggtctgccaaggctgcgtcctaacgggcctctgggtcatcgcccacgaatgcggccaccacgccttcagcgactac

SEQ ID NO: 2356 - DNA, 348 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcccctctactgggcctgccaaggctgcgtcctaacgggcctctgggtcagcgcccacgaatgcggccaccacgccttcagcgactac

SEQ ID NO: 2357 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctctcctacttggcctctctactgggccggccagggctgcgtcctaacgggcctctgggtcatagcccacgagtgcggccaccacgccttcagcgactac

SEQ ID NO: 2358 - DNA, 348 bp, Artificial
  Mutation in BnaC.FAD2.b introduced by TALE nuclease pair BnFAD2_T01
caggatccatgggtgcaggtggaagaatgcaagtgtctcctcactccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctccccccccctctcccttccctggcccctctactgggcctgccaaggctgcgtcctaacgggcctctgggtcatcgcccacgaatgcggccaccacgccttcagcgactac

SEQ ID NO: 2359 - DNA, 387 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacaacggctgataggatcccccaatccctttttcactgcatctggcccctctactgggcctgccaaggctgcgtcctaacgggcctctgggtcatcgcccacgaatgcggccaccacgccttcagcgactac

SEQ ID NO: 2360 - DNA, 350 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacccctggcccctctactgggcctgccaaggctgcgtcctaacgggcctctgggtcatcgcccacgaatgcggccaccacgccttcagcgactac

SEQ ID NO: 2361 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacccctggcccctctactgggcctgccaaggctgcgtcctaacgggcctctgggtcatcgcccacgaatgcggccaccacgccttcagcgactac

SEQ ID NO: 2362 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctccgcctggcccctctactgggcctgccaagggtgcgtcctaaccggcgtctgggtcatagcccacgagtgcgtccaccacgccttcagcgactac

SEQ ID NO: 2363 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttggcctctctactgggcctgccaagggtgcgtcctaaccggcgtctgggtcatagcccacgagtgcggccaccacgccttcagcgactac

SEQ ID NO: 2364 - DNA, 351 bp, Artificial
  Mutation in BnaC.FAD2.b introduced by TALE nuclease pair BnFAD2_T01
caggatccatgggtgcaggtggaagaatgcaagtgtctactccctccagctcccccgaaaccaaaaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 2365 - DNA, 342 bp, Artificial
  Mutation in BnaC.FAD2.b introduced by TALE nuclease pair BnFAD2_T01
caggatccatgggtgcagctgcaagaatgcaagtctctcctccatccagctcccccgaacccaaaacccacaaacccgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagccacgatggcggcaagcaggcgctggagcctggcccctctactgggcctgccaaggctgcgtcctaacgggcctctgggtcatcgcccacgaatgcggccaccacgccttcagcgactac

SEQ ID NO: 2366 - DNA, 422 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttaccgctggcaagcaggcgctggagccggtccagcggctgttgccggtgctgtgccaggcccacggcttgacccccctggcccctctactgggcctgccaaggctgcgtcctaacgggcctctgggtcatcgcccacgaatgcggccaccacgccgtcagcgactac

SEQ ID NO: 2367 - DNA, 357 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctcccccttacctcgccgcctggcccctctactgggcctgccaaggctgcgtcctaacgggcctctgggtcatcgcccacgaatgcggccaccacgccttcagcgactac

SEQ ID NO: 2368 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgatacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaagggtgcgtcctaaccggcgtctgggtcatagcccacgagtgcggccaccacgccttcagcgactac

SEQ ID NO: 2369 - DNA, 260 bp, Artificial
  Mutation in BnaC.FAD2.b introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttaccacgccttcgcgactac

SEQ ID NO: 2370 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccctcaccgcgcccctctactgggcctgccaaggctgcgtcctaacgggcctctgggtcatagcccacgagtgcggccaccacgccttcagcgactac

SEQ ID NO: 2371 - DNA, 343 bp, Artificial
  Mutation in BnaC.FAD2.b introduced by TALE nuclease pair BnFAD2_T01
caggatccatgggtgcaggaggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacccctctactgggccggccaaggctgcgtcctaacgggcctctgggtcatagcccacgagtgcggccaccacgccttcagcgactac

SEQ ID NO: 2372 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaacacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctgcccctctactgggcctgccagggctgcgtcctaaccggcgtctgggtcatagcccacgagtgcggccaccacgccttcagcgactac

SEQ ID NO: 2373 - DNA, 341 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcagaaagcaatcccacctcactgcttcaaacgctccatccctcgctccttctcctacctcctcttcgacatcctcgtctcctcctccctctaccacctctccacagccacgatggcggcaagcaggcgctggagcctggcccctctactgggcctgccaaggctgcgtcctaacgggcctctgggtcatcgcccacgaatgcggccaccacgccttcagcgactac

SEQ ID NO: 2374 - DNA, 349 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctactttggcctctctactgggcctgccaagggtgcgtcctaaccggcgtctgggtcatagcccacgagtgcggccaccacgccttcagcgactac

SEQ ID NO: 2375 - DNA, 421 bp, Artificial
  Mutation in BnaC.FAD2.b introduced by TALE nuclease pair BnFAD2_T01
caggatccatgggtgcaggtggaagaatgcaagtctctactccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctgccagacatcaaataaaacgaaaggctcagtctcggtcgttcggctgcggcgagcggtatcagctcactcaaagcctggcctctctactgggcctgccagggctgcgtcctaaccggcgtctgggtcatagcccacgagtgcggccaccacgccttcagcgactac

SEQ ID NO: 2376 - DNA, 349 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 2377 - DNA, 354 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgtcgtggcccctctactgggcctgccaaggctgcgtcctaaccggcgtctgggtcatagcccacgagtgcggccaccacgccttcagcgactac

SEQ ID NO: 2378 - DNA, 358 bp, Artificial
  Mutation in BnaC.FAD2.b introduced by TALE nuclease pair BnFAD2_T01
caggatccattggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgcttcaaacgctccatccctcgctccttctcctacctcctcttcgacatcctcgtctcctcctccctctaccacctctccacagcctacttccctctcctccccccccctctcccttacctcgcctcgtctggcccctctactgggcctgccaaggctgcgtcctaacgggcctctgggtcatcgcccacgaatgcggccaccacgccttcagcgactac

SEQ ID NO: 2379 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggatacctcaagaaagcaatcccacctcactgcttcaaacgctccatccctcgctccttctcctacctcctcttcgacatcctcgtctcctcctccctctaccacctctccacagcctacttccctctcctcccccaccctctctcccggcctctctactgggcctgccagggctgcgtcctaaccggcgtctgggtcatagcccacgagtgcggccaccacgccttcagcgactac

SEQ ID NO: 2380 - DNA, 325 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcgccaagggtgcgtcctaaccggcgtctgggtcataacccacgagtgcggccaccacgccttcagcgactac

SEQ ID NO: 2381 - DNA, 481 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacactccttctcctcttcgacatcatcatctcctcctcggctcctccctctaccacctctccacagcctacttccctcccctcccccacccccttaccacagtagcgtatgcgcccacgcaactggtccagaaccttgaccgaacgcagcggtggtaccggcgcagtggcggttttcagggcttgttatgaaggtggtggccatcgccagccacgatggcggcaacagccgctggagcccctctactgggcctgccaaggctgcgtcctaacgggcctctgggtcatcgcccacgaatgcggccaccacgccttcagcgactac

SEQ ID NO: 2382 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgtcatcctcgtctcctcctccctctaccacctctccacagcctacttccctctcctcccccaccctctcccttcccttggcccctctactgggcctgccaaggctgcgtcctaacgggcctctgggtcatagcccacgagtgcggccaccacgccttcagcgactac

SEQ ID NO: 2383 - DNA, 345 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctactcctctctactgggcctgccaagggtgcgtcctaaccggcgtctgggtcatagcccacgagtgcggccaccacgccttcagcgactac

SEQ ID NO: 2384 - DNA, 345 bp, Artificial
  Mutation in BnaC.FAD2.b introduced by TALE nuclease pair BnFAD2_T01
caggatccatgggtgcaggtggaagaatgcaagtctctactccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctactcccctctcctcccccaccctctcccttacctccctctactgggcctgccaaggctgcgtcctaacgggcctctgggtcatcgcgcacgaatgcgtccagcacgcctttagcgactac

SEQ ID NO: 2385 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagccacgatggcggcaagcaggcgctggagcctagcccctctactgggcctgccaaggctgcgtcctaacgggcctctgggtcatagcccacaagtgcggccaccgcgcctgcagcgactac

SEQ ID NO: 2386 - DNA, 351 bp, Artificial
  Mutation in BnaC.FAD2.b introduced by TALE nuclease pair BnFAD2_T01
caggatccatgggtgcaggtggaagaatgcaagtgtatcctccctccaaaaagtctgaaaccgacaccatcaagcgcgtaccctgcgagacaccgcccttcactgtcggagacctcaagaaagcaatcccacctcactgcttcaaacgctccatccctcgctccttctcctcttcgacatcatcatctcctcctcgtctcctcctccctctaccacctctccacagcctacttccctctcctcccccaccctctcccttcccggcccctctactgggcctgccaaggctgcgtcctaacgggcctctgggtcatcgcccacgaatgcggccaccacgccttcagcgactac

SEQ ID NO: 2387 - DNA, 342 bp, Artificial
  Mutation in BnaC.FAD2.b introduced by TALE nuclease pair BnFAD2_T01
gcaggatccatgggtgcaggtggaagaatgcaagtctaacctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctccctctaccacctctccacagcctacttccctctcctcccccaccctctcccttacctcgcccctctactgggcctgccaaggctgcgtcctaacgggcctctgggtcatcgcccacgaatgcggccaccacgccttgagcgactac

SEQ ID NO: 2388 - DNA, 311 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcatcatctcctcctcggctcctccctcaccctctctcctacttgcctctctactgggcctgccaagggtgcgtcctaaccggcgtctgggtcatagcccacgagtgcggccaccacgccttcagcgactac

SEQ ID NO: 2389 - DNA, 331 bp, Artificial
  Mutation in BnaC.FAD2.b introduced by TALE nuclease pair BnFAD2_T01
caggatccatgggtgcaggtggaagaatgcaagtctctactccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctggcccctctactgggcctgccaaggctgcgtcctaacgggcctctgggtcatcgcccacgaatgcggccaccacgccttcagcgactac

SEQ ID NO: 2390 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccaccgcctacttccctctcccccccccccctctcccgtatggcccctctactgggcctgccaaggcggcgtcctaacgggcctctgggtcatcgcccacgaatgcggccaccacgccttcagcgactac

SEQ ID NO: 2391 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccatcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 2392 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctcggctcctccctctaccacctctccacagcctacttccctctcccttacctctggcccctctactgggcctgccaaggctgcgtcctaacgggcctctgggtcatcgcccacgaatgcggccaccacgccttcagcgactac

SEQ ID NO: 2393 - DNA, 344 bp, Artificial
  Mutation in BnaC.FAD2.b introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccaccgcctacttccctctcctcccccaccctctccactggcccctctactgggcctgccaaggctgcgtcctaacgggcctctgggtcatcgcccacgaatgcggccaccacgccttcagcgactac

SEQ ID NO: 2394 - DNA, 338 bp, Artificial
  Mutation in BnaC.FAD2.b introduced by TALE nuclease pair BnFAD2_T01
caggatccatgggtgcaggtggaagaatgcaagtctctactccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttacctcgctggcccctctacggggcctgccaaggctgcgtcctgacgggcctctgggtcatagcccacgagtgcggccaccacgccttcagcgactac

SEQ ID NO: 2395 - DNA, 340 bp, Artificial
  Mutation in BnaC.FAD2.b introduced by TALE nuclease pair BnFAD2_T01
aggatccatgggtgcaggtggaagaatgcaagtctctcctccctccagctcccccggaaccaacaccctcaaacgcgtcccctgcgagacaccaccattaactctcggagacctcaagaaagcaatcccacctcactgcttcaaacgctccatcccacgctccttctcctcttcgacatcctcgtctcctcctccctctaccacctctccacagcctacttccctctcctcccccaccctctcccttacctggcccctctactgggcctgccaaggctgcggcctaacgggcctctgggtcatcgcccacgaatgcggccaccacgccttcagcgactac

SEQ ID NO: 2396 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttctgcctctctactgggcctgccagggctgcgtcctaaccggcgtctgggtcatagcccacgagtgcggccaccacgccttcagcgactac

SEQ ID NO: 2397 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcgcctggcctctctactgggcctgccaagggtgcgtcctaaccggcgtctgggtcatagcccacgagtgcggccaccacgccttcagcgactac

SEQ ID NO: 2398 - DNA, 353 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatcccacgctccttctcctcttcgacatcatcctctcctcctcggctcctccctctaccacctctccacagcctacttccctctcctcccccaccctctcccttcccccgccgggccctctactgggcctgccaaggctgcgtcctaacgggcctctgggtcatagcccacgagtgcggccaccacgccttcagcgactac

SEQ ID NO: 2399 - DNA, 340 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctcgccctccctctactgggcctgccaaggctgcgtcctaacgggcctctgggtcatcgcccacgaatgcggccaccacgcctgcagcgactac

SEQ ID NO: 2400 - DNA, 455 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttccctcgcctgctgccgatggcctccccctgctccggggtcaagccgtgggcctggcacagccccggggcggcgtgaccgcagtggaggcagtgcatgcatggcgctcgcctggcccctctactgggcctgccaaggctgcgtcctaacgggcctctgggtcatcgcccacgaatgcggccaccacgccttcagcgactac

SEQ ID NO: 2401 - DNA, 326 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcctcttcgacatcctcgtctcctcctccctctaccacctctccacagcctacttccctctcctccccctctactgggcctgccaaggctgcgtcctaacgggcctctgggtcatcgcccacgaatgcggccaccacgccttcagcgactac

SEQ ID NO: 2402 - DNA, 349 bp, Artificial
  Mutation in BnaC.FAD2.b introduced by TALE nuclease pair BnFAD2_T01
caggatccatgggtgcaggtggaagaatgcaagtctctactccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 2403 - DNA, 441 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctactggtggccatcgccagccacgatggtggcaagcaggcgctggagacggtccagcggctgttgccggtgctgtgccaggcccacggcttgacccctggcctctctactgggcctgccaaggctgcgtcctaacgggcctctgggtcatcgcccacgaatgcggccaccacgccttcagcgactac

SEQ ID NO: 2404 - DNA, 261 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactctcggagacctcaagaaagcaatcccacctcactgcttcaaacgctccatcccacgctccttctcctcttcgacatcatcatctcctcctcggctcctccctctaccacctctccacagcctacttccctctcccttaccacgccttcagcgactac

SEQ ID NO: 2405 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacggcctctctactgggcctgccagggctgcgtcctaaccggcgtctgggtcatagcccacgagtgcggccaccacgccttcagcgactac

SEQ ID NO: 2406 - DNA, 349 bp, Artificial
  Mutation in BnaC.FAD2.b introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 2407 - DNA, 348 bp, Artificial
  Mutation in BnaC.FAD2.b introduced by TALE nuclease pair BnFAD2_T01
caggatccatgggggcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctccatccctcgctccttctcctacctcctcttcgacatcctcgtctcctcctccctctaccacctctccacagcctacttccctctcctcccccaccctctcccttacctcgcccctctactgggcctgccaaggctgcgtcctaacgggcctctgggtcatcgcccacgaatgcggccaccacgccttcagcgactac

SEQ ID NO: 2408 - DNA, 330 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcgtctcctcctccctctaccacctctccacagcctacttccctctcctcccccaccctctcccctctactgggcctgccaaggctgcgtcctaacgggcctctgggtcatcgcccacgaatgcggccaccacgccttcagcgactac

SEQ ID NO: 2409 - DNA, 349 bp, Artificial
  Mutation in BnaC.FAD2.b introduced by TALE nuclease pair BnFAD2_T01
caggatccatgggtgcaggtggaagaatgcaagtatctcctccctccagctcccccggaaccaacaccctcaaacgcgtcccctgcgagacaccaccattactcttggagaccctcagaaagcaatcccaactcactgcttcaaacgctccatccctccctccttctcctacctcctcttcgacatcctcgtctcctcctccctctaccacctctccacagcctacttccctctcctcccccaccctctcccttgcctctggcccctctactgggcctgccaaggctgcgtcctaacgggcctctgggtcatagcccacgagtgcggccaccactccttcagcgactac

SEQ ID NO: 2410 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaaccggcgtctgggtcatagcccacgagtgcggccaccacgtcttcagcgactac

SEQ ID NO: 2411 - DNA, 332 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttacctcgcctctactgggcctgccaaggctgcgtcctaacgggcctctgggtcatagcccacgagtgcggccaccacgccttcagcgactac

SEQ ID NO: 2412 - DNA, 349 bp, Artificial
  Mutation in BnaC.FAD2.b introduced by TALE nuclease pair BnFAD2_T01
caggatccatgggtgcaggtggaagaatgcaagtatctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttaccttggcccctctactgggcctgccaaggctgcgtcctaacgggcctctgggtcatcgcccacgaatgcggccaccacgccttcagcgactac

SEQ ID NO: 2413 - DNA, 336 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctgggcctgccaaggctgcgtcctaacgggcctctgggtcatcgcccacgaatgcggccaccacgccttcagcgactac

SEQ ID NO: 2414 - DNA, 343 bp, Artificial
  Mutation in BnaC.FAD2.b introduced by TALE nuclease pair BnFAD2_T01
caggatccatgggtgcaggtgcaagaatgcaagtctctcctcactccagctcccccggaaccaacaccctcaaacgcgtcccctgcgagacaccaccattcactctcggagaactcaagaaagcaatcccacctcactgcttcaaacgctccatccctcgctccttctcctacctcctcttcgacatcctcgtctcctcctccctctaccacctctccacagcctacttccctctcctccctcaccctctctcctacctctctactgggcctgccaagggtgcgtcctaaccggcgtctgggtcatagcccacgagtgcggccaccacgcctgcagcgactac

SEQ ID NO: 2415 - DNA, 372 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctctccagcggctgttgccgccatcgtgcccctctactgggcctgccaaggctgcgtcctaacgggcctctgggtcatcgcccacgaatgcggccaccacgccttcagcgactac

SEQ ID NO: 2416 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccggcccctctactgggcctgccaaggctgcgtcctaacgggcctcttggtcatcgcccacgaatgcggccaccacgccttcagcgactac

SEQ ID NO: 2417 - DNA, 315 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctcaccctctctcctacttctgggcctctctactgggcctgccaagggtgcgtcctaaccggcgtctgggtcatagcccacgagtgcggccaccacgccttcagcgactac

SEQ ID NO: 2418 - DNA, 355 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcgccctggcccctctactgggcctgccagggctgcgtcctaacgggcctctgggtcatagcccacgagtgcggccaccacgccttcagcgactac

SEQ ID NO: 2419 - DNA, 348 bp, Artificial
  Mutation in BnaC.FAD2.b introduced by TALE nuclease pair BnFAD2_T01
caggatccatgggtgcaggtggaagaatgcaagtatctcctccctccagctcccccggaaccaacaccctcaaacgcgtcccctgcgagacaccaccattcactctcggtgacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 2420 - DNA, 457 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctcccctccttccgcggctgttgccggtgctgtgccaggcccccggcttgaccccccagcaggtggtggccatcgccagcaatggcggtggcaagcaggcgctggagacggtcccgcctggcctctctactgggcctgccagggctgcgtcctaaccggcgtctgggtcatagcccacgagtgcggccaccacgccttcagcgactac

SEQ ID NO: 2421 - DNA, 345 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctcactctaccacctctccacagcctacttccctctcctcccccaccctctctccttggcctctctactgggcctgccaagggtgcgtcctaaccggcgtctgggtcatagcccacgagtgcggccaccacgccttcagcgactac

SEQ ID NO: 2422 - DNA, 312 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactgtcggagaactcaagaaagcaatcccaccgcactgcttcaaacgctccatccctcgctccttctcctacctcctcttcgacatcctcgtctcctcctccctctaccacctctccacagcctacttccctctgggtctgccaaggctgcgtcctaacgggcctctgggtcatcgcccacgaatgcggccaccacgccttcagcgactac

SEQ ID NO: 2423 - DNA, 343 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatccctcgctccttctcctacctcctcttcgacatcctcgtctcctcctccctctaccacctctccacagcctacttccctctcctccccccccctctcccttacccctctactgggcctgccaaggctgcgtcctaacgggcctctgggtcatcgcccacgaatgcggccaccacgccttcagcgactac

SEQ ID NO: 2424 - DNA, 333 bp, Artificial
  Mutation in BnaC.FAD2.b introduced by TALE nuclease pair BnFAD2_T01
caggatccatgggtgcaggtggaagaatgcaagtctctcctccctccagctcccccagaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctactgggcctgacagggctgcgtcctaacgggcctctgggtcatagcccacgagtgcggccaccacgccttcagcgactac

SEQ ID NO: 2425 - DNA, 323 bp, Artificial
  Mutation in BnaC.FAD2.b introduced by TALE nuclease pair BnFAD2_T01
caggatccatgggtgcaggtggaagaatgcaagtttctcctccctccagctcccccggaaccaacaccctcaaacgcgtcccctgcgagacaccaccattcactctcggagacctcaagaaagcaatcccacctcactgcttcaaacgctccatcccacgctccttctcctcttcgccatcctcgtctcctcctccctctaccacctctccacagcctacttccctctcctccctggcccctctactgggcctgccaaggcggcgtcctaacggtcctctgggtcatcgcccacgaatgcggccaccacgccttcagcgacta

SEQ ID NO: 2426 - DNA, 353 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctcccacctctccacagcctacttccctctcctccctcaccctctctcctaccgccctggcctctctactgggcctgccagggctgcgtcctaaccggcgtctgggtcatagcccacgagtgcggccaccacgccttcagcgactac

SEQ ID NO: 2427 - DNA, 339 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctccccccccaccctctccctctctactgggcctgccaagggtgcgtcctaaccggcgtctgggtcatagcccacgagtgcggccaccacgccttcagcgactac

SEQ ID NO: 2428 - DNA, 344 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctccactggcccctctactgggcctgccagggctgcggcctaaccggcgtctgggtcatagcccacgagtgcggccaccacgccttcagcgactac

SEQ ID NO: 2429 - DNA, 336 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctcccccaccctctctcctaactctctactgggcctgccaagggtgcgtcctaaccggcgtctgggtcatagcccacgagtgcggccaccacgccttcagcgactac

SEQ ID NO: 2430 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatagcccacgagtgcggccaccacgccttcagcgactac

SEQ ID NO: 2431 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccacctcactgcttcaaacgctcgatccctcgctctttctcctacctcatctgggacatcatcatagcctcctgcttctactacgtcgccaccacttacttccctctcctcccccaccctctcccttacctctactgggcctgccaaggctgcgtcctaacgggcctctgggtcatcgcccacgaatgcggccaccacgccttcagcgactac

SEQ ID NO: 2432 - DNA, 351 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgcttcaaacgctccatcccacgctccttctcctcttcgacatcatcatctcctcctcggctcctccctctaccacctctccacagcctacttccctctcctcccccaccctctcccttacctctggcccctctactgggcctgccaaggctgcgtcctaacgggcctctgggtcatagcccacgagggcggccaccacgccttcagcgactac

SEQ ID NO: 2433 - DNA, 340 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcctcccccaccctcccccaccctctactgggcctgccaaggctgcgtcctaacgggcctctgggtcatcgcccacgaatgcggccaccacgccttcagcgactac

SEQ ID NO: 2434 - DNA, 354 bp, Artificial
  Mutation in BnaC.FAD2.b introduced by TALE nuclease pair BnFAD2_T01
caggatccatgggtgcaggtggaagaatgcaagtctctcctcactccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccctggcccctctactgggcctgccaaggctgcgtcctaacgggcctctgggtcatcgcccacgaatgcggccaccacgccttcagcgactac

SEQ ID NO: 2435 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttacccctctactgggcctgccaaggctgcgtcctaacgggcctctgggtcatcgcccacgaatgcggccaccacgccttcagcgactac

SEQ ID NO: 2436 - DNA, 311 bp, Artificial
  Mutation in BnaC.FAD2.b introduced by TALE nuclease pair BnFAD2_T01
caggatccatgggtgcaggtggaagaatgcaagtctctcctcccttcagctcccccggaaccaacaccctcaaacgcgtcccctgcgagacaccaccattcactctcggagacctcaagaaagcaatcccacctcactgcttcaaacgctccatcccacgctccttctcctcttcgacatcgtcatctcctcctcggctcctccctcaccctctctcctacttgcctctctactgggcctgccaagggtgcgtcctaaccggcgtctgggtcatagcccaccagtgcggccaccacgccttcagcgactac

SEQ ID NO: 2437 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactacttcaaacgctccatccctcgctccttctcctacctcctcttcgacatcctcgtctcctcctccctctaccacctctccacagcctacttccctctcctcccccaccctctcccttcccttggcccctctactgggcctgccaaggctgcgtcctaacgggcctctgggtcatcgcccacgaatgcggccaccacgccttcagcgactac

SEQ ID NO: 2438 - DNA, 346 bp, Artificial
  Mutation in BnaC.FAD2.b introduced by TALE nuclease pair BnFAD2_T01
caggatccatgggtgcaggtggaagaatgcaagtctctcctcccttcagctcccccgaaaccaaaaccctcaaacgcgtcccctgcgagacaccacccttcactctcggagacctcaagaaagcaatcccacctcactgctttaaacgctcgatccctcgctctttctcctacctcatctgggacatcatcatagcctcctgcttctactacgtcgccaccgcttacttccctctcctcccccaccctctcccatacctgccctctacggggcctgccaaggctgcgtcctaacgggcctctgggtcatcgcccacgaatgcggccaccacgccttcagcgactac

SEQ ID NO: 2439 - DNA, 349 bp, Artificial
  Mutation in BnaC.FAD2.b introduced by TALE nuclease pair BnFAD2_T01
caggatccatgggtgcaggtggaagaatgcaagtctctcctccatccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 2440 - DNA, 394 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttgcctctaagggcgagatccggtgcagattatttggattgagagtgaatattgcccctctactgggcctgccaaggctgcgtcctaacgggcctctgggtcatagcccacgagtgcggccaccacgccttcagcgactac

SEQ ID NO: 2441 - DNA, 268 bp, Artificial
  Mutation in BnaC.FAD2.b introduced by TALE nuclease pair BnFAD2_T01
caggatccatgtgtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcatcatctcctcctcggctcctccctctaccacctctccacagcctacttccctctcccttaccacgccttcagcgactac

SEQ ID NO: 2442 - DNA, 341 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctcccccgtacctctactgggcctgccaaggctgcgtcctaacgggcctctggggcatagcccacgagtgcggccaccacgccttcatcgactac

SEQ ID NO: 2443 - DNA, 347 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctcccctctactgggcctgccaaggctgcgtcctaacgggcctctgggtcatagcccaccagtgcggccaccacgcctgcagcgactac

SEQ ID NO: 2444 - DNA, 343 bp, Artificial
  Mutation in BnaC.FAD2.b introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttccccctctactgggcctgccaaggctgcgtcctaacgggcctctgggtcatagcccacgagtgcggccaccacgccttcagcgactac

SEQ ID NO: 2445 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcctcgactccgctaccctctaccacctctccacagcctacctccctctcctccccctccctctcccttaccttggcccctctactgggcctgccaaggctgcgtcctaacgggcctctgggtcatcgcccacgagtgcggccaccacgccttcagcgactac

SEQ ID NO: 2446 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccctcactctcggagacctcaagaaagcaatcccacctcactgcttcaaacgctccatccctcgctccttctcctacctcctcttcgacatcctcgtctcctcctccctctaccacctctccacagcctacttccctctcatccccccccctctcccttcccctggcccctctactgggcctgccaaggctgcgtcctaacgggcctctgggtcatcgcccacgaaggcggccaccactccttcagcgactac

SEQ ID NO: 2447 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttaccttggcccctctactgggcctgccaaggctgcgtcctaacgggcctctgggtcatcgcccacgaatgcggccaccacgccttcagcgactac

SEQ ID NO: 2448 - DNA, 350 bp, Artificial
  Mutation in BnaC.FAD2.b introduced by TALE nuclease pair BnFAD2_T01
caggatccatgggtgcaggtggaagaatgcaagtcccccctccatccagctcccccggaaccaacaccctcaaacgcgtcccctgcgagacaccacccttaactctcggagacctcaagaaagcaatcccacctcactgcttcaaacgctccatccctcgctccttctcctacctcctcttcgacatcctcgtctcctcctccctctaccacctctccacagcctccttccctctcctccccccccctctcccgtaccactggcccctctactgggcctgccaaggctgcgtcctaacgggcctctggggcatcgcccacaaatggggcctccatgccatcagcgactac

SEQ ID NO: 2449 - DNA, 358 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctccccccccctctcccttacctcgcctcgtctggcccctctactgggcctgccaaggctgcgtcctaacgggcctctgggtcatcgcccacgaatgcggccaccacgccttcagcgactac

SEQ ID NO: 2450 - DNA, 350 bp, Artificial
  Mutation in BnaC.FAD2.b introduced by TALE nuclease pair BnFAD2_T01
caggatccatgggtgcaggtggaagaatgcaagtgtctcctccctccagctcccccgaaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctctggcccctctactgggcctgccaaggctgcgtcctaacgggcctctgggtcatcgcccacgaatgcggccaccacgccatcagcgactac

SEQ ID NO: 2451 - DNA, 259 bp, Artificial
  Mutation in BnaC.FAD2.b introduced by TALE nuclease pair BnFAD2_T01
caggatccatggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcccttaccacgccttcagcgactac

SEQ ID NO: 2452 - DNA, 344 bp, Artificial
  Mutation in BnaC.FAD2.b introduced by TALE nuclease pair BnFAD2_T01
caggatccatgggtgcaggtgcaagaatgcaagtctcccctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctcgcgcctacctctctactgggcctgccaagggtgcgtcctaacgggcctctgggtcatcgcccacgaatgcggcgaccacgccatcagcgactac

SEQ ID NO: 2453 - DNA, 336 bp, Artificial
  Mutation in BnaC.FAD2.b introduced by TALE nuclease pair BnFAD2_T01
caggatccatgggtgcaggtggaagaatgcaagtctctactccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccctccctctcccttacctgggcctgccaaggctgcgtcctaacgggcctctgggtcatcgcccacgaatgcggccaccacgccttcagcgactac

SEQ ID NO: 2454 - DNA, 332 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctactgggcctgccaagggtgcgtcctaaccggcgtctgggtcatagcccacgagtgcggccaccacgccttcagcgactac

SEQ ID NO: 2455 - DNA, 338 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttagacatcctcgtctcctcctccctctaccacctctccaccgcctacttccctctcctccccctccctctccctctctactgggcctgccaagggtgcgtcctaaccggcgtctgggtcatagcccacgagtgcggccaccacgccttcagcgactac

SEQ ID NO: 2456 - DNA, 355 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcgcctggcccctctactgggcctgccaaggctgagtcctaacgggcctctgggtcatcgcccacgaatgcggccaccacgccttcagcgactac

SEQ ID NO: 2457 - DNA, 337 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctgcttccctctcctcccccacccactcccttacctgggcctgccaaggctgcgtcctaacgggccactgggtcatcgcccacgaatgcggccaccgcgccttcagcgactac

SEQ ID NO: 2458 - DNA, 332 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctggcccctctactgggcctgccaaggctgcgtcctaacgggcctctgggtcatagcccacgagtgcggccaccacgcctgcagcgactac

SEQ ID NO: 2459 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctcccccttaccccctctactgggcctgccaaggctgcgtcctaacgggcctctgggtcatcgcccacgaatgcggccaccacccttcagcgactac

SEQ ID NO: 2460 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttgcctctctactgggcctgccagggctgcgtcctaaccggcgtctgggtcatagcccacgagtgcggccaccacgccttcagcgactac

SEQ ID NO: 2461 - DNA, 350 bp, Artificial
  Mutation in BnaC.FAD2.b introduced by TALE nuclease pair BnFAD2_T01
caggatccatgggtgcaggtggaagaatgcaagtgtctactcactccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccccctggcccctctactggtcctgccaaggctgcgtcctaacgggcctctgtgtcatagcccacgagtgcggccaccacgccttcagcgactac

SEQ ID NO: 2462 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcctctctactgggcctgccagggctgcgtcctaaccggcgtctgggtcatagcccacgagtgcggccaccacgccttcagcgactac

SEQ ID NO: 2463 - DNA, 429 bp, Artificial
  Mutation in BnaC.FAD2.b introduced by TALE nuclease pair BnFAD2_T01
caggatccatgggtgcaggtggaagaatgcaagtctatcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacccctccagcggcggtggccggtgctgtgccaggcccacggcttgaccccggagcaggtggtggccatcgccagccacgatggtggcccctctaccgggcctgccaaggctgcgtcctaacgggcctctgggtcatagcccacgagtgcggccaccacgccttcagcgactac

SEQ ID NO: 2464 - DNA, 423 bp, Artificial
  Mutation in BnaC.FAD2.b introduced by TALE nuclease pair BnFAD2_T01
caggatccatgggtgcaggtagaagaatgcaagtccatcccccctccagctcccccggaaccaacaccctcaaacgcgtcccctgcgagacaccacccttcactctcggagacctcaagaaagcaatcccacatcactgcttcaaacgctccatcccacgctccttctcctcttcgacatcatcatctcctcctcggctcctccctctaccacctctccacagcctacttccctctccccccccacccccccccttacctcgttgccggtgctgtgccaggcctacggcttgaccccggagcaggtggtggccatcgccagcaatattggtgctggcccctctactggggcggccaaggctgcgtcctaacgggcctctgggtcagagcccacgaatgcggccaccacgccttcagcgactac

SEQ ID NO: 2465 - DNA, 332 bp, Artificial
  Mutation in BnaC.FAD2.b introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttatggcccctctactgggcctgccaaggctgcgtcctaacgggcctctgggtcatcgcccacgaatgcggccaccacgccttcagcgactac

SEQ ID NO: 2466 - DNA, 380 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttcccccgctcgccgcagccgaacgaccgagcgcagcggggcccctctactgggcctgccaaggctgcgtcctaacgggcctctgggtcatagcccacgagtgcggccaccacgcctcagcgactac

SEQ ID NO: 2467 - DNA, 345 bp, Artificial
  Mutation in BnaC.FAD2.b introduced by TALE nuclease pair BnFAD2_T01
caggatccatgggtgcaggtggaagaatgcaagtcactcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctatcctctctactgggcctgccagggctgcgtcctaaccggcgtctgggtcatagcccacgagtgcggccaccacgccttcagcgactac

SEQ ID NO: 2468 - DNA, 358 bp, Artificial
  Mutation in BnaC.FAD2.b introduced by TALE nuclease pair BnFAD2_T01
caggatccatgggtgcaggtggaagaatgcaagtctctcctccatccagctcccccggaaccaacaccctcaaacgcgtcccctgcgagacaccaccattcactctcggagacctcaagaaagcaatcccacctcactgcttcaaacgctccatcactcgctccttctcctacctcctcttcgacatcctcgtctcctcctccctctaccacctctccacagcctacttccctctcctcccccaccctctcccttacctcgcctcgtctggcccctctactgggcctgccaaggctgcgtcctaacgggcctctgggtcatcgccctcgaatgcggccaccacgccttcagcgactac

SEQ ID NO: 2469 - DNA, 349 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttccctcggcccctctactgggcctgccaaggctgcgtcctaacgggcctctgggtcatagcccacgagtgcggccaccacgccttcagcgactac

SEQ ID NO: 2470 - DNA, 319 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatctcctcctcggctcctccctcaccctctctcctacttggcctctctactgggcctgccaagggtgcgtcctaaccggcgtctgggtcatagcccacgagtgcggccaccacgccttcagcgactac

SEQ ID NO: 2471 - DNA, 352 bp, Artificial
  Mutation in BnaC.FAD2.b introduced by TALE nuclease pair BnFAD2_T01
caggatccatgggtgcaggtggaagaatgcaagtctctcatccctccagctcccccgaaaccaaaaccctcaaacgcgtcccctgcgagacaccacccttcactctcggaaccctcaagaaaccaatcccactccactgcttcaaacgtcccatcccccgctccttctcctccctcctcttcgccttcctcgcctcctcccccccctcccccctctccacagcctacttccctctcctcccccaccctctcccttaccccgcctggccctctactgggcctgccaaggctgcgtcctaacgggcctctgggtcatcgcccacgaatgcggccaccacgccatcagcgactac

SEQ ID NO: 2472 - DNA, 333 bp, Artificial
  Mutation in BnaC.FAD2.b introduced by TALE nuclease pair BnFAD2_T01
caggatccatgggtgcaggtggaagaatgcaagtctctcctccatccagctcccccggaaccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctccctcaccctctctcctactttactgggcctgccagggctgcgtcctaacgggcctctgggtcatagcccacgagtgcggccaccacgccttcagcgactac

SEQ ID NO: 2473 - DNA, 326 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcccccccctctactgggcctgccaaggctgcgtcctaacgggcctctgggtcatcgcccacgaatgcggccaccacgccttcagcgactac

SEQ ID NO: 2474 - DNA, 354 bp, Artificial
  Mutation in BnaC.FAD2.b introduced by TALE nuclease pair BnFAD2_T01
caggatccatgggtgcaggtggaagaatgcaagtctatcctccctccagctcccccggaaccaacaccctcaaccgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctctcacttaccgcgccccggcccctctactgggcctgccaaggctgcgtcctaacgggcctcggggtcaacgcccgccagtgcggtgtccacgccttcatcgactac

SEQ ID NO: 2475 - DNA, 339 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctccccctctactgggcctgccaaggctgcgtcctaacgggcctctgggtcatcgccaacgaatgcggccaccacgccttcagcgactac

SEQ ID NO: 2476 - DNA, 329 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctgggcctgccagggctgcgtcctaacgggcctctgggtcatcgcccacgaatgcggccaccacgccttcagcgactac

SEQ ID NO: 2477 - DNA, 358 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgcctcgtctggcccctctactgggcctgccaaggctgcgtcctaacgggcctctgggtcatagcccacgagtgcggccaccacgccttcagcgactac

SEQ ID NO: 2478 - DNA, 344 bp, Artificial
  Mutation in BnaC.FAD2.b introduced by TALE nuclease pair BnFAD2_T01
caggatccatgggtgcaggtggaagaatgcaagtctatcctccatccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttggcccctctactgggcctgccaaggctgcgtccgaacgggcctctgggtcatcgcccacgaatgcggccaccacgccatcagcgactac

SEQ ID NO: 2479 - DNA, 354 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccctggcccctctactgggcctgccaaggctgcgtcctaacgggcctctgggtcatcgcccacgaatgcggccaccacgccttcagcgactac

SEQ ID NO: 2480 - DNA, 343 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctccgcccccaccctcacccttacccctctactgagcctgccaaggctgcgtcctaacgggcctctgggtcatcgcccacaaatgcggccaccacgccatcaacgactgc

SEQ ID NO: 2481 - DNA, 350 bp, Artificial
  Mutation in BnaC.FAD2.b introduced by TALE nuclease pair BnFAD2_T01
caggatccatgggtgcaggtggaagaatgcaagtgtatcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctctcctactttggcctctctactgggcctgccaagggtgcgtcctaaccggcgtctgggtcatagcccacgagtgcggccaccacgccttcagcgactac

SEQ ID NO: 2482 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatactcgtctcctcctccctctaccacctctccacagcctacttccctctcctcccccgccctctcccttaccttggcccctctactgggcctgccaaggctgcgtcctaacgggcctctgggtcatcgcccacgaatgcggccaccacgccttcagcgactac

SEQ ID NO: 2483 - DNA, 353 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgtcgtggcccctctactgggcctgccaaggctgcgtcctaacgggcctctgggtcatcgcccacgaatgcggccaccacgccttcagcgacta

SEQ ID NO: 2484 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcgcagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 2485 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatcccacgctccttctcctcttcgacatcatcatctcctcctccctctaccacctctccacagcctacttccctctcctcccccaccctctcccttacccctggcccctctactgggcctgccaaggctgcgtcctaacgggcctcggggtcatagcccacgagtgcggccaccacgccttcagcgactac

SEQ ID NO: 2486 - DNA, 336 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttacctctggcccctctactgggcctgccaaggctgcgtcctaacgggcctctgggtcatcgcccacgaatgcggccaccacgccttcagcgactac

SEQ ID NO: 2487 - DNA, 261 bp, Artificial
  Mutation in BnaC.FAD2.b introduced by TALE nuclease pair BnFAD2_T01
caggatccatgggtgcaggtggaagaatgcaagtatctcctccctccagctcccccgaaaccaaaaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttaccacgccttcagcgactac

SEQ ID NO: 2488 - DNA, 348 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaactggcccctctactgggcctgccaaggctgcgtcctaacgggcctctgggtcatcgcccacgaatgcggccaccacgccttcagcgactac

SEQ ID NO: 2489 - DNA, 335 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctacatcccacgctccttctcctcttcgacatcatcatctcctcctcggctcctccctctaccacctctccacagcctacttccctctcccttaccttggcccctctactgggcctgccaaggctgcgtcctaacgggcctctgggtcatcgcccacgaatgcggccaccacgccttcagcgactac

SEQ ID NO: 2490 - DNA, 342 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctcttcgacatcctcgtctcctcctccctctaccacctctccacagcctacttccctctcctcccccaccctctcccttaccttggcccctctactgggcctgccaaggctgcgtcctaacgggcctctgggtcatagcccacgagtgcggccaccacgccttcagcgactac

SEQ ID NO: 2491 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggacccaacaccctcaaacgcgtcccctgcgagacaccaccattcactctcggagacctcaagaaagcaatcccacctcactgcttcaaacgctccatcccacgctccttctcctacctcctcttcgacatcctcgtctcctcctccctctaccacctctccacagcctacttccctctcctcccccaccctctcccttacctctggcccctctactgggcctgccaaggctgcgtcctaacgggcctctgggtcatcgcccacgaatgcggccaccacgccttcagcgactac

SEQ ID NO: 2492 - DNA, 351 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacctcgcggcctctctactgggcctgccagggctgcgtcctaaccggcgtcggggtcatagcccacgagtgcggccaccacgccttcagcgactac

SEQ ID NO: 2493 - DNA, 314 bp, Artificial
  Mutation in BnaC.FAD2.b introduced by TALE nuclease pair BnFAD2_T01
caggatccatgggtgcaggtggaagaatgcaagtctctcatccctccagctcccccgaaaccaaaaccctcaaacgcgtcccctgcgagacaccacccttcactctcggagacctcaagaaagcaatcccacctcactgctccaaacgctccatccctcgctccttctcctcttcgacatcatcatctcctcctcggctcctccctctaccacctctcctactttggcctctctactgggcctgccaagggtgcgtcctaaccggggtctgggtcatagcccacgagtgcggccacgacgccttcatcgactac

SEQ ID NO: 2494 - DNA, 340 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttactgggcctgccagggctgcgtcctaaccggcgtctgggtcagagcccacgagtgcggccaccacgccttcagcgactac

SEQ ID NO: 2495 - DNA, 339 bp, Artificial
  Mutation in BnaC.FAD2.b introduced by TALE nuclease pair BnFAD2_T01
caggatccatgggtgcaggtgaaagaatgcaagtctcccctccctacagctcccccggacccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctcccccaccctctcccttacctcccctctactgggcctgccaaggctgcgtcctaacgggcctctgggtcatcgcccacgaatgcggccaccacgccttctgcgactac

SEQ ID NO: 2496 - DNA, 337 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctcgcccctctactgggcctgccaaggctgcgtcctaaccggcgtctgggtcatagcccacgagtgcggccaccacgccttcagcgactac

SEQ ID NO: 2497 - DNA, 261 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctactcttcgacatcatcatctcctcctcggctcctccctctaccacctctccacagcctacttccctctcccttacctcgcattcagcgactac

SEQ ID NO: 2498 - DNA, 354 bp, Artificial
  Mutation in BnaC.FAD2.b introduced by TALE nuclease pair BnFAD2_T01
caggatccatgggtgcaggtggaagaatgcaagtctcacctccctccagctcccccgaaaccaaaaccctcaaccgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgccctggcctctctactgggcctgccaagggtgcgtcctaaccggcgtcggggtcatagtccacgagtgcggccaccacgccttcagcgactac

SEQ ID NO: 2499 - DNA, 336 bp, Artificial
  Mutation in BnaC.FAD2.b introduced by TALE nuclease pair BnFAD2_T01
caggatccatgggtgcaggtggaagaatgcaagtctctcatccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctccctctaccacctctccacagcctacttccctctcctcccccaccctctccctggcccctctactgggcctgccaaggctgcgtcctaacgggcctctgggtcatcgcccacgaatgcggccaccacgccttcagcgactac

SEQ ID NO: 2500 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctccctcaccctctctcctacttcggcctctctactgggcctgccagggctgcgtcctaaccggcctctgggtcatagcccacgagtgcggccaccacgccttcagcgactac

SEQ ID NO: 2501 - DNA, 343 bp, Artificial
  Mutation in BnaC.FAD2.b introduced by TALE nuclease pair BnFAD2_T01
caggatccatgggtgcaggtggaagaatgcaagtctatcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctactctctactgcgcctgccagggctgcgtcctaaccggcgtctgggtcatagcccacgagtgcggccaccacgccttcagcgactac

SEQ ID NO: 2502 - DNA, 343 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactcttggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttgcccctctacggggcctgccgaggctgcgtgctaacgggcctctgggtcatcgcccacgaatgcggccaccacgccttcagcgactac

SEQ ID NO: 2503 - DNA, 261 bp, Artificial
  Mutation in BnaC.FAD2.b introduced by TALE nuclease pair BnFAD2_T01
caggatccatgggtgcaggtagaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttaccacgccttcagcgactac

SEQ ID NO: 2504 - DNA, 350 bp, Artificial
  Mutation in BnaC.FAD2.b introduced by TALE nuclease pair BnFAD2_T01
caggatccatgggtgcaggtggaagaatgcaagtctatcctccctccagctcccccggaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccccgccggcccctctactgggcctgccaaggctgcgtcctaaccggcgtctgggtcatagcccacgagtgcggccaccacgccgtcagcgtac

SEQ ID NO: 2505 - DNA, 350 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccgctggcccctctactgggcctgccaaggctgcgtcctaacgggcctctgggtcatcgcccacgaatgcggccaccacgccttcagcgactac

SEQ ID NO: 2506 - DNA, 349 bp, Artificial
  Mutation in BnaC.FAD2.b introduced by TALE nuclease pair BnFAD2_T01
caggatccatgggtgcaggtggaagaatgcaagtctcccctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctctcccttacctggcccctctactgggcctgccaaggctgcgtcctaacgggcctctgggtcatcgcccacgaatgcggccaccacgccttcagcgactac

SEQ ID NO: 2507 - DNA, 340 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaaacgcgtcccctgcgagacaccaccattcactctcggagacctcaagaaagcaatcccacctcactgcttcaaacgctccatcccacgctccttctcctcttcgacatcatcatctcctcctccctctaccacctctccacagcctacttccctctcctcccccaccctctcccttcccggcccctctactgggcctgccaaggctgcgtcctaacgggcctctgggtcatcgcccacgaatgcggccaccacgccttcagcgactac

SEQ ID NO: 2508 - DNA, 381 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacaccctacttccctctcctcccccaccctctcccttacctcgctcgccgcagccgaacgaccgagcgcagcgtggcccctctactgggcctgccaaggctgcgtcctaacgggcctctgggtcatcgcccacgaatgcggccaccacgccttcagcgactac

SEQ ID NO: 2509 - DNA, 357 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctccatccctcgctccttctcctacctcctcttcgacatcatcatctcctcctcggctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 2510 - DNA, 349 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaattcggccaccacgccttcagcgactac

SEQ ID NO: 2511 - DNA, 394 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctaagggcgagatccggtgcagattatttggattgagagtgaatattgcccctctactgggcctgccaaggctgcgtcctaacgggcctctgggtcatcgcccacgaatgcggccaccacgccttcagcgactac

SEQ ID NO: 2512 - DNA, 349 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 2513 - DNA, 338 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttacctcgcctgaccctctactgggcctgccaaggctgcgtcctaacgggcctctgggtcagagcccacgagtgcggccaccacgccttcagcgactac

SEQ ID NO: 2514 - DNA, 346 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgcctctactgggcctgccaaggctgcgtcctaacggacctctgggtcatcgcccacgaatgcggccaccacgccttcagcgactac

SEQ ID NO: 2515 - DNA, 349 bp, Artificial
  Mutation in BnaC.FAD2.b introduced by TALE nuclease pair BnFAD2_T01
caggatccatgggtgcaggtggaagaatgcaagtctcccctccctccagctcccccgaaaccaaaaccctcaaacgcgtcccctgcgagacaccacccttcactctcggagacctcaagaaagcaatcccacctcactgcttcaaacgctccatccctcgctctttctcctacctcatctgggacatcatcatagcctcctgcttctactacgtcgccaccacttacttccctctcctcccccaccctctcccttacctcggcccctctactgggcctgccaaggctgcgtcctaacgggcctctggttcatcgcccacgaatgcggccaccacgccttcagcgactac

SEQ ID NO: 2516 - DNA, 331 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccatcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccctggcccctctactgggcctgccaaggctgcgtcctaacgggcctctggttcatcgcccacgagtgcggccaccacgccttcagcgactac

SEQ ID NO: 2517 - DNA, 340 bp, Artificial
  Mutation in BnaC.FAD2.b introduced by TALE nuclease pair BnFAD2_T01
caggatccatgggtgcaggtggaagaatgcaagtctcccctccctccagctcccccggaaccaacaccctcaaacgcgtcccctgcgagacaccaccattcactctcggagacctcaagaaagcaatcccaccgcactgtttcaaacgctcgatccctcgctctttctcctcttcgacatcatcatctcctcctcggctcctccctctaccacctctccacagcctacttccctctcctccctcaccctctctcctacttactgggcctgccagggctgcgtcctaaccggcgtctgggtcatagcccacgagtgcggccaccacgccttcagcgactac

SEQ ID NO: 2518 - DNA, 375 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaccgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacgccaggctcatcttggacaagaagaagatcgctctctactgggccggccaagggtgcgtcctaacgggcctctgggtcatagcccacgagtgcggcgaccacgccttcagcgactac

SEQ ID NO: 2519 - DNA, 349 bp, Artificial
  Mutation in BnaC.FAD2.b introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttaccttggcccctctactgggcctgccaaggctgcgtcctaacgggcctctgggtcatcgcccacgaatgcggccaccacgccttcagcgactac

SEQ ID NO: 2520 - DNA, 355 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctcccccaccctcgcccttacctccgcctggcccctctactgggcctgccaaggctgcgtcctaacgggcctctgggtcatcgcccacgaatgcggccaccacgccttcagcgactac

SEQ ID NO: 2521 - DNA, 342 bp, Artificial
  Mutation in BnaC.FAD2.b introduced by TALE nuclease pair BnFAD2_T01
caggatccatgggtgcaggtggaagaatgcaagtctctccaccctccagctcccccgaaaccaaaaccatcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctccccccccctctcccttaccctctactgggcctgccaaggctgcgtcctaacgggcctctgggtcatcgcccacgaatgcggccaccacgccttcagcgactac

SEQ ID NO: 2522 - DNA, 261 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctcttcgacatcatcatctcctcctcggctcctccctctaccacctctccacagcctacttccctctcccttaccacgccttcagcgactac

SEQ ID NO: 2523 - DNA, 338 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcccttacctcgcctgaccctctactgggcctgccaaggctgcgtcctaaccggcgtctgggtcatagcccacgagtgcggccaccacgccttcagcgactac

SEQ ID NO: 2524 - DNA, 374 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcctcgtctcctcctccctctaccacctctccacagcctacttccctctcctcccccaccctctcccttacctcgctcgccgcagccgaacgaccgagcgcagcgtggcccctctactgggcctgccaagactgcgtcctaacgggcctctgggtcatcgcccacgaatgtggccaccacgccttcagcgactac

SEQ ID NO: 2525 - DNA, 349 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactctcggagacctcaagaaagcaatcccacctcactgcttcaaacgctccatccctcgctccttctcctacctcctcttcgacatcctcgtctcatcctccctctaccacctctccacagcctacttccctctcctcccccaccctctcccttaccttggcccctctacggggcctgccaaggctgcgtcctaacgggcctctggggcatcgcccacgaatgcggccaccacgccttcagcgactac

SEQ ID NO: 2526 - DNA, 350 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctactttggcctctctactgggcctgccagggctgcgtcctaacgggcctctgggtcatcgcccacgaatgcggccaccacgccttcagcgactac

SEQ ID NO: 2527 - DNA, 373 bp, Artificial
  Mutation in BnaC.FAD2.b introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttacctctccagcgcctgcttgccgccatcgtgcccctctactgggcctgccaaggctgcgtcctaacgggcctctgggtcatagcccacgagtgcggccaccacgccttcagcgactac

SEQ ID NO: 2528 - DNA, 355 bp, Artificial
  Mutation in BnaC.FAD2.b introduced by TALE nuclease pair BnFAD2_T01
caggatccatgggtgcaggtgcaagaatgcaagtctcacctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctcgctcctacgtcgccctggcctctctactgggcctgccaagggtgcgtcctaaccggcgtctgggtcatagcccacgagtgcggccaccgcgccatgagcgactac

SEQ ID NO: 2529 - DNA, 337 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatagcctcctgcttctactacgtcgccaccacttacttccctctcctccctcaccctctctcctagcctctctactgggcctgccagggctgcgtcctaacgggcctctgggtcatcgcccacgaatgcggccaccacgccttcagcgactac

SEQ ID NO: 2530 - DNA, 379 bp, Artificial
  Mutation in BnaC.FAD2.b introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctctttgatccggttcctgaacaggatctatttgatggcctctctactgggcctgccaagggtgcgtcctaaccggcgtctgggtcatagcccacgagtgcggccaccacgccttcagcgactac

SEQ ID NO: 2531 - DNA, 352 bp, Artificial
  Mutation in BnaC.FAD2.b introduced by TALE nuclease pair BnFAD2_T01
caggatccatgggtgcaggtggaagaatgcaagtctctcctccctccagctcccccggaaccaaaaccctcaaacgcgtcccctgcgagacaccacccttcactctcggagacctcaagaaagcaatcccacctcactgcttcaaacgctccatccctcgctccttctcctacctcctcttcgacatcctcgtctcctcctccctctaccacctctccacagcctacttccctctcctcccccaccctctcccttccctcgccggcccctctactgggcctgccaaggctgcgtcctaacgggcctctgggtcatcgcccacgaatgcggccaccacgccttcagcgactac

SEQ ID NO: 2532 - DNA, 356 bp, Artificial
  Mutation in BnaC.FAD2.b introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctcccttacctcgccacctggcccctctactgggccggccaaggctgcgtcctaacgggcctctgggtcatcgcccacgaatgcggccaccacgccttcagcgactac

SEQ ID NO: 2533 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcacgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgccttcagcgactac

SEQ ID NO: 2534 - DNA, 350 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccccccccctctctcctacttctggcctctctactgggcctgccagggctgcgtcctaaccggcgtctgggtcatagcccacgagtgcggccaccacgccttcagcgactac

SEQ ID NO: 2535 - DNA, 348 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 2536 - DNA, 349 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgggcctctctactgggccggccaagggtgcgtcctaaccggcgtctgggtcatagcccaagagtgcggccaccacgccttcagcgactac

SEQ ID NO: 2537 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactggacctgccaagggtgcgtcctaaccggcgtctgggtcatagcccacgagtgcggccaccacgccttcagcgactac

SEQ ID NO: 2538 - DNA, 339 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgccggcctgccagggctgcgtcctaaccggcgtctgggtcatagcccacgagtgcggccaccacgccttcagcgactac

SEQ ID NO: 2539 - DNA, 351 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccacactgtttcaaacgctcgatccctcgctctttctcctacctcatctgggacatcatcatagcctcctgcttctactacgtcgccaccacttacttccctctcctccctcaccctctctcctacttcatggcctctctactgggcctgccagggctgcgtcctaaccggcgtctgggtcatagcccacgagtgcggccaccacgccttcagcaactac

SEQ ID NO: 2540 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccgccctggcctctctactgggcctgccagggctgcgtcctaaccggcgtctgggtcatagcccacgagtgcggccaccacgccttcagcgactac

SEQ ID NO: 2541 - DNA, 334 bp, Artificial
  Mutation in BnaA.FAD2.a introduced by TALE nuclease pair BnFAD2_T01
caggatacatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcacccactctctactgggcctgccagggctgcgtcctaaccggcgtctgggtcatagtccacgagtgcggccaccacgccttcagcgactac

SEQ ID NO: 2542 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccagggctgcgtcctaaccggcgtctgggtcatagcccacgagtgcggccaccacgccttcagcgactac

SEQ ID NO: 2543 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctccatccctcgctctttctcctacctcatctgggacatcatcatagcctcctgcttctactacgtcgccaccacttacttccctctcctccctcaccctctctcctggcctctctactgggcctgccaagggtgcgtcctaaccggcgtctgggtcatagcccacgagtgcggccaccacgccttcagcgactac

SEQ ID NO: 2544 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgccttcagcgactac

SEQ ID NO: 2545 - DNA, 357 bp, Artificial
  Mutation in BnaA.FAD2.a introduced by TALE nuclease pair BnFAD2_T01
caggatccatgggtgcaggtggaagaatgcaagtgtctcctccctccaagaagtctgagaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgcccgcctggcctctctactgggcctgccagggctgcgtcctaaccggcgtctgggtcatagcccacgagtgcggccaccacgccttcagcgactac

SEQ ID NO: 2546 - DNA, 340 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccagggctgcgtcctaaccggcgtctgggtcatagcccacgagtgcggccaccacgccttcagcgactac

SEQ ID NO: 2547 - DNA, 355 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccagggctgcgtcctaaccggcgtctgggtcatagcccacgagtgcggccaccacgccttcagcgactac

SEQ ID NO: 2548 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactggggctgccagggctgcgtcctaaccggcgtctgggtcatagcccacgagtgcggccaccacgccttcagcgactac

SEQ ID NO: 2549 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaacgggcctctgggtcatagcccacgagtgcggccaccacgccttcagcgactac

SEQ ID NO: 2550 - DNA, 354 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccttggcctctctactgggcctgccagggctgcgtcctaacgggcctctgggtcatcgcccacgaatgcggccaccacgccttcagcgactac

SEQ ID NO: 2551 - DNA, 430 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtccccaccacttacttccctctcctccctcaccctctctcctacgtatgtacggccagcaacgtcggttcgagatggcgctcgatgacgccaacgatggccgccacctgctccggggtcaagccagttggcctctctactgggcctgccagggctgcgtcctaaccggcgtctgggtcatcgcccacgaatgcggccaccacgccttcagcgactac

SEQ ID NO: 2552 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 2553 - DNA, 340 bp, Artificial
  Mutation in BnaA.FAD2.a introduced by TALE nuclease pair BnFAD2_T01
caggatccatgggtgcaggtggaagaatgcatgtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttactgggcctgccagggctgcgtcctaaccggcgtctgggtcatagcccacgagtgcggccaccacgccttcagcgactac

SEQ ID NO: 2554 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgtgacatcatcatagcctcctgcttctactacgtcgccaccacttacttccctctcctccctcaccctctctccctggcctctctactgggcctgccagggctgcgtcctaaccggcgtctgggtcatagcccacgagtgcggccaccacgccttcagcgactac

SEQ ID NO: 2555 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccagggctgcgtcctaaccggcgtctgggtcatagcccacgagtgcggccaccacgccttcagcgactac

SEQ ID NO: 2556 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaattccaccgcactgtttcaaacgctcgatccctcgctctttctcctacctcatctgggacatcatcatagcctcctgcttctactacgtcgccaccacttacttccctctcctccctcaccctctctcctacttctctactgggcctgccagggctgcgtcctaaccggcgtctgggtcatagcccacgagtgcggccaccacgccttcagcgactac

SEQ ID NO: 2557 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccagggctgcgtcctaaccggcgtctgggtcatagcccacgagtgcggccaccacgccttcagcgactac

SEQ ID NO: 2558 - DNA, 322 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacctcagcggctgatgccggtgctgtgccaggcccacgagtgcggccaccacgccttcagcgactac

SEQ ID NO: 2559 - DNA, 335 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccagggctgcgtcctaaccggcgtctgggtcatagcccacgagtgcggccaccacgccttcagcgactac

SEQ ID NO: 2560 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 2561 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgccttcagcgactac

SEQ ID NO: 2562 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctctatccctcgctctttctcctacctcatctgggacatcatcatagcctccttcttctactacgtcgccaccacttacttccctctcctccctcaccctctctcctacttatggcctctctactgggcctgccagggctgcgtcctaacgggcctctgggtcatcgcccacgaatgcggccaccacgccttcagcgactac

SEQ ID NO: 2563 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgagtgcggccaccacgccttcagcgactac

SEQ ID NO: 2564 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 2565 - DNA, 332 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcatagcccacgagtgcggccaccacgccttcagcgactac

SEQ ID NO: 2566 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccaagggtgcgtcctaaccggcgtctgggtcatagcccacgagtgcggccaccacgccttcagcgactac

SEQ ID NO: 2567 - DNA, 352 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccgccttggcctctctactgggcctgccagggctgcgtcctaaccggcgtctgggtcatagcccacgagtgcggccaccacgccttcagagactac

SEQ ID NO: 2568 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgccttcagcgactac

SEQ ID NO: 2569 - DNA, 261 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctccatcccacgctccttctcctcttcgacatcatcatctcctcctcggctcctccctctaccacctctccacagcctacttccctctcccttaccacgccttcagcgactac

SEQ ID NO: 2570 - DNA, 336 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctccatcccacgctccttctcctcttcgacatcatcatctcctcctcggctcctccctctaccacctctccacagcctacttccctctcccttacctctggcccctctactgggcctgccaaggctgcgtcctaacgggcctctgggtcatagcccacgagtgcggccaccacgccttcagcgactac

SEQ ID NO: 2571 - DNA, 439 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcgtctgggacatcatcatagcctcctgcttctactacgtcgccaccacttacttccctctcctccctcaccctctcccctaggtccagcgcctgcttgccgccatcgtggctggcgatggccaccccctgctccggggtcaagccgtgggcctggcacagcaccggcaagcaggcgctgtctctactgggcctgccagggctgcgtcctaaccggcgtctgggtcatagcccacgagtgcggccaccacgccttcagcgactac

SEQ ID NO: 2572 - DNA, 340 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccagggctgcgtcctaaccggcgtctgggtcatagcccacgagtgcggccaccacgccttcagcgactac

SEQ ID NO: 2573 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcggcctctctactgggcctgccagggctgcgtcctaaccggcgtctgggtcatagcccacgagtgcggccaccacgccttcagcgactac

SEQ ID NO: 2574 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 2575 - DNA, 358 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcaccgggtctggcctctctactaggcctgccagggctgcgtcctaaccggcgtctgggtcatagcccacgagtgcggccaccacgccttcagcgactac

SEQ ID NO: 2576 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctggcctctctactgggcctgccaagggtgcgtcctaaccggcgtctgggtcatagcccacgagtgcggccaccacgccttcagcgactac

SEQ ID NO: 2577 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttggcctctctactgggcctgccaagggtgcgtcctaaccggcgtctgggtcatagcccacgagtgcggccaccacgccttcagcgactac

SEQ ID NO: 2578 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 2579 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcccctggcctctctactgggcctgccaagggtgcgtcctaaccggcgtctgggtcatagcccacgagtgcggccaccacgccttcagcgactac

SEQ ID NO: 2580 - DNA, 277 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcgccttcagcgactac

SEQ ID NO: 2581 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 2582 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccagggctgcgtcctagccggcgtctgggtcatagcccacgagtgcggccaccacgccttcagcgactac

SEQ ID NO: 2583 - DNA, 332 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcagcctctctactgggcctgccaagggtgcgtcctaaccggcgtctgggtcatagcccacgagtgcggccaccacgccttcagcgactac

SEQ ID NO: 2584 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatcctctctactgggcctgccagggctgcgtcctaaccggcgtctgggtcatagcccacgagtgcggccaccacgccttcagcgactac

SEQ ID NO: 2585 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttatggcctctctactgggcctgccagggctgcgtcctaaccggcgtctgggtcatagcccacgagtgcggccaccacgccttcagcgactac

SEQ ID NO: 2586 - DNA, 350 bp, Artificial
  Mutation in BnaA.FAD2.a introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaacgggcctctgggtcatagcccacgagtgcggccaccacgccttcagcgactac

SEQ ID NO: 2587 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 2588 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagctcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcgcccctctactgggcctgccagcgctgcgtcctaaccggcgtctgggtcatagcccacgagtgctgccaccacgccttcagcgacac

SEQ ID NO: 2589 - DNA, 348 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaacgggcctctgggtcatagcccacgagtgcggccaccacgccttcagcgactac

SEQ ID NO: 2590 - DNA, 386 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggccaccacctgctggggggtcaagccgtgggcctggcacagtctctactgggcctgccagggctgcgtcctaaccggcgtctgggtcatagcccacgagtgcggccaccacgccttcagcgactac

SEQ ID NO: 2591 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccagggctgcgtcctaaccggcgtctgggtcatagcccacgagtgcggccaccacgccttcagcgactac

SEQ ID NO: 2592 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgcctggcctctctactgggcctgccagggctgcgtcctaaccggcgtctgggtcatagcccacgagtgcggccaccacgccttcagcgactac

SEQ ID NO: 2593 - DNA, 329 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgggcctgccagggctgcgtcctaaccggcgtctgggtcatagcccacgagtgcggccaccacgccttcagcgactac

SEQ ID NO: 2594 - DNA, 334 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcacccactctctactgggcctgccaggactgcgtcctaaccggcgtctgggtcatagcccacgagtgcggccaccacgccttcagcgactac

SEQ ID NO: 2595 - DNA, 356 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccacgccttcagcgactac

SEQ ID NO: 2596 - DNA, 349 bp, Artificial
  Mutation in BnaA.FAD2.a introduced by TALE nuclease pair BnFAD2_T01
caggatccatgggtgcaggtgggagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccagggctgcgtcctaaccggcgtctgggtcatagcccacgagtgcggccaccacgccttcagcgactac

SEQ ID NO: 2597 - DNA, 348 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 2598 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaacgggcctctgggtcatagcccacgagtgcggccaccacgccttcagcgactac

SEQ ID NO: 2599 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctggcctctctactgggcctgccagggctgcgtcctaaccggcgtctgggtcatagcccacgagtgcggccaccacgccttcagcgactac

SEQ ID NO: 2600 - DNA, 380 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacagtggtccggcgcacgcgctctggaggcctgcctctctagtgggcctgccaagggtgcgtcctaaccggcgtctgggtcatagcccacgagtgcggccaccacgccttcagcgactac

SEQ ID NO: 2601 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 2602 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccagggctgcgtcctaaccggcgtctgggtcatagcccacgagtgcggccaccacgccttcagcgactac

SEQ ID NO: 2603 - DNA, 339 bp, Artificial
  Mutation in BnaA.FAD2.a introduced by TALE nuclease pair BnFAD2_T01
caggatccatgggtgcaggttgaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctactgggcctgccatggctgcgtcctaaccggcgtctgggtcatagcccacgagtgcggccaccacgccttcagcgactac

SEQ ID NO: 2604 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 2605 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 2606 - DNA, 351 bp, Artificial
  Mutation in BnaA.FAD2.a introduced by TALE nuclease pair BnFAD2_T01
caggatccatgggtgcaggtggaagaatgcaagtgtctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcggcctctctactgggcctgccagggctgcgtcctaaccggcgtctgggtcatagcccacgagtgcggccaccacgccttcagcgactac

SEQ ID NO: 2607 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 2608 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccaagggtgcgtcctaaccggcgtctgggtcatagcccacgagtgcggccaccacgccttcagcgactac

SEQ ID NO: 2609 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggcctctctactgggcctgccaagggtgcgtcctaaccggcgtctgggtcatagcccacgagtgcggccaccacgccttcagcgactac

SEQ ID NO: 2610 - DNA, 436 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctggctggcgatggccaccccctgctccggggtcaagccgtgggcctggcatctctgccaaatagttgggagccaatgagggcaggcctctctactgggcctgccaagggtgcgtcctaaccggcgtctgggtcatagcccacgagtgcggccaccacgccttcagcgactac

SEQ ID NO: 2611 - DNA, 349 bp, Artificial
  Mutation in BnaA.FAD2.a introduced by TALE nuclease pair BnFAD2_T01
caggatccatgggtgcaggtggaagaatgcaagtgtctcctccatccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 2612 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 2613 - DNA, 329 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgggcctgccagggctgcgtcctaaccggcgtctgggtcatagcccacgagtgcggccaccacgccttcagcgactac

SEQ ID NO: 2614 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccacactgtttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgagtgcggccaccacgccttcagcgactac

SEQ ID NO: 2615 - DNA, 354 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccttggcctctctactgggcctgccagggctgcgtcctaaccggcgtctgggtcatagcccacgagtgcggccaccacgccttcagcgactac

SEQ ID NO: 2616 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccaagggtgcgtcctaaccggcgtctgggtcatagcccacgagtgcggccaccacgccttcagcgactac

SEQ ID NO: 2617 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccggcctctctactgggcctgccagggctgcgtcctaaccggcgtctgggtcatagcccacgagtgcggccaccacgccttcagcgactac

SEQ ID NO: 2618 - DNA, 342 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacttcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctcgactgggcctgccagggctgcgtcctaaccggcgtctgggtcaaagcccacgagtgcggccaccacgccttcagcgactac

SEQ ID NO: 2619 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagtccacgagtgcggccaccacgccttcagcgactac

SEQ ID NO: 2620 - DNA, 348 bp, Artificial
  Mutation in BnaA.FAD2.a introduced by TALE nuclease pair BnFAD2_T01
caggatccatgggtgcaggtggaagaatgcaagtgtctcctccctcctgctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccatctcctccctcaccctctctcctacttggcctctctactgggcctgccagggctgcgtcctaaccggcgtctgggtcatagcccacgagtgcggccaccacgccttcagcgactac

SEQ ID NO: 2621 - DNA, 357 bp, Artificial
  Mutation in BnaA.FAD2.a introduced by TALE nuclease pair BnFAD2_T01
caggatccatgggtgcagtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctcgcctggcctctctactgggcctgccagggctgcgtcctaacgggcctctgggtcatagcccacgagtgcggccaccacgccttcagcgactac

SEQ ID NO: 2622 - DNA, 323 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgaaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcttgccaagggtgcgtcctaaccggcgtctgggtcatagcccacgagtgcggccaccacgccttcagcgactac

SEQ ID NO: 2623 - DNA, 430 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttatgtacggccagcaacgtcggttcgagatggcgctcgatgacgccaacgatggccaccacctgctccggggtcaagccagttggcctctctactgggcctgccagggctgcgtcctaaccggcgtctgggtcatagcccacgagtgcggccaccacgccttcagcgactac

SEQ ID NO: 2624 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctctcctactcctctctactgggcctgccaagggtgcgtcctaaccggcgtctgggtcatagcccacgagtgcggccaccacgccttcagcgactac

SEQ ID NO: 2625 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttctggcctctctaatgggcctgccaagggtgcgtcctaaccggcgtctgggtcatagcccacgagtgcggccaccacgccttcagcgactac

SEQ ID NO: 2626 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgattcctcgctctttctcctacctcatctgggacatcatcatagcctcctgcttctactacgtcgccaccacttacttccctctcctccctcaccctctctcctacttcggcctctctactgggcctgccagggctgcgtcctaaccggcgtctgggtcatagcccacgagtgcggccaccacgccttcagcgactac

SEQ ID NO: 2627 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcctctctactgggcctgccagggctgcgtcctaaccggcgtctgggtcatagcccacgagtgcggccaccacgccttcagcgactac

SEQ ID NO: 2628 - DNA, 338 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctctctactgggcctgccaagggtgcgtcctaaccggcgtctgggtcatagcccacgagtgcggccaccacgccttcagcgactac

SEQ ID NO: 2629 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 2630 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttccctctggcccctctactgggcctgccaaggctgcgtcctaacgggcctctgggtcatcgcccacgaatgcggccaccacgccttcagcgactac

SEQ ID NO: 2631 - DNA, 325 bp, Artificial
  Mutation in BnaA.FAD2.a introduced by TALE nuclease pair BnFAD2_T01
caggatccatgggtgcaggtggaagaatgcaagtctctcctccctccagctcccccggaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggctgcgtcctaaccggcgtctgggtcatagcccacgagtgcggccaccacgccttcagcgactac

SEQ ID NO: 2632 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccagggctgcgtcctaaccggcgtctgggtcatagcccacgagtgcggccaccacgccttcagcgactac

SEQ ID NO: 2633 - DNA, 358 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctccgccgggtctggcctctctactaggcctgccagggctgcgtcctaaccggcgtctgggtcatagcccacgagtgcggccaccacgccttcagcgactac

SEQ ID NO: 2634 - DNA, 342 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccagggtgcgtcctaaccggcgtctgggtcatagcccacgagtgcggccactacgccttcagcgactac

SEQ ID NO: 2635 - DNA, 411 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttaacgcaggaaagaacatgtgagcaaaaggccagcaaaaggccaggaaccgtaaaaaggccgcgggcctctctactgggcctgccagggctgcgtcctaaccggcgtctgggtcatagcccacgagtgcggccaccacgccttcagcgactac

SEQ ID NO: 2636 - DNA, 424 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctcctcccccagcgcctgcttgccgccatcgtggctggcgatggcccccccctgctccggggtcaagccgtgggcctggcatggcctctctactgggcctgccaagggtgcgtcctaaccggcgtctgggtcatagcccacgagtgcggccaccacgccttcagcgactac

SEQ ID NO: 2637 - DNA, 325 bp, Artificial
  Mutation in BnaA.FAD2.a introduced by TALE nuclease pair BnFAD2_T01
caggatccatgggtgcaggtggaagaatgcaagtccctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggctgcgtcctaaccggcgtctgggtcatagcccacgagtgcggccaccacgccttcagcgactac

SEQ ID NO: 2638 - DNA, 349 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctccctcggcctctctactgggcctgccagggctgcgtcctaaccggcgtctgggtcatagcccacgagtgcggccaccacgccttcagcgactac

SEQ ID NO: 2639 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctggatcatagcccacgagtgcggccaccacgccttcagcgactac

SEQ ID NO: 2640 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctactgggcctgccaagggtgcgtcctaaccggcgtctgggtcatagcccacgagtgcggccaccacgccttcagcgactac

SEQ ID NO: 2641 - DNA, 356 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaacgggcctctgggtcatagcccacgagtgcggccaccacgccttcagcgactac

SEQ ID NO: 2642 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccagggctgcgtcctaaccggcgtctgggtcatagcccacgagtgcggccaccacgccttcagcgactac

SEQ ID NO: 2643 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggcctctctactgggcctgccagggctgcgtcctaaccggcgtctgggtcatagcccacgagtgcggccaccacgccttcagcgactac

SEQ ID NO: 2644 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgtttcaaacgctcgatccctcgctctttctcctacctcatctgggacatcatcatagcctcctgcttctactacgtcgccaccacttacttccctctcctccctcaccctctctccccctgcctctctactgggcctgccaagggtgcgtcctaaccggcgtctgggtcatagcccacgagtgcggccaccacgccttcagcgactac

SEQ ID NO: 2645 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgtttcaaacgctcgatccctcgctctttctcctacctcatctgggacatcatcatagcctcctgcttctactacgtcgccactacttacttccctctcctccctcaccctctctcctaggcctctctactgggcctgccaggcctgcgtcctagccggcgtctgggtcatagcccacgagtgcggccaccacgccttcagcgactac

SEQ ID NO: 2646 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 2647 - DNA, 342 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccagggctgcgtcctaaccggcgtctgggtcatagcccacgagtgcggccaccacgccttcagcgactac

SEQ ID NO: 2648 - DNA, 381 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgctcgccgcagccgaacgaccgagcgcagcgtggcccctctactgggcctgccaaggctgcgtcctaacgggcctctgggtcatcgcccacgaatgcggccaccacgccttcagcgactac

SEQ ID NO: 2649 - DNA, 349 bp, Artificial
  Mutation in BnaA.FAD2.a introduced by TALE nuclease pair BnFAD2_T01
caggatccatgggtgcaggtggaagaatgcaagtctctcctccctccagctaccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgctggcctctctactgggcctgccagggctgcgtcctaaccggcgtctgggtcatagcccacgagtgcggccaccacgccttcagcgactac

SEQ ID NO: 2650 - DNA, 349 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctccctcggcctctctactgggcctgccagggctgcgtcctaaccggcgtctgggtcatagcccacgagtgcggccaccacgccttcagcgactac

SEQ ID NO: 2651 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 2652 - DNA, 415 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggagacgatggccaccacctgctggggggtcaagttgagcggggcacccgtcagtgcatgcatggcctctctactgggcctgccagggctgcgtcctaaccggcgtctgggtcatagcccacgagtgcggccaccacgccttcagcgactac

SEQ ID NO: 2653 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctttcctggcctctctactgggcctgccagggctgcgtcctaaccggcgtctgggtcatagcccacgagtgcggccaccacgccttcagcgactac

SEQ ID NO: 2654 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccccctctcctccttcggcctctctactgggcctgccagggctgcgtcctaaccggcgtctgggtcatagcccacgagtgcggccaccacgccttcagcgactac

SEQ ID NO: 2655 - DNA, 357 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctccgcccgccttgcctctctactgggcctgccagggctgcgtcctaaccggcgtctgggtcatagcccacgagtgcggccaccacgccttcagcgactac

SEQ ID NO: 2656 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctaccacctctccacagcctacttccctctcctcccccaccctctcccttacctgggcccctctactgggcctgccaaggctgcgtcctaacgggcctctgggtcatcgcccacgaatgcggccaccacgccttcagcgactac

SEQ ID NO: 2657 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaatcaatcccaccgcactgtttcaaacgctcgatccctcgctctttctcctacctcatctgggacatcatcatagcctcctgcttctactacgtcgccaccacttacttccctctcctccctcaccctctctcctacttctggcatctctactgggcctgccaagggtgcgtcctaaccggcgtctgggtcatagcccacgagtgcggccaccacgccttcagcgactac

SEQ ID NO: 2658 - DNA, 357 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatccgggacatcatcatagcctcctgcttctactacgtcgccaccacttacttccctctcctccctcaccctctctcctacttcgcgcgcctggcctctctactgggcctgccagggctgcgtcctaaccggcgtctgggtcatagcccacgagtgcggccaccacgccttcagcgactac

SEQ ID NO: 2659 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaatggcctctctactgggcctgccagggctgcgtactaaccggcgtctgggtcatagcccacgagtgcggccaccacgccttcagcgactac

SEQ ID NO: 2660 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggtctctctactgggcctgccagggctgcgtcctaaccggcgtctgggtcatagcccacgagtgcggccaccacgccttcagcgactac

SEQ ID NO: 2661 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatcctctctactgggcctgccagggctgcgtcctaaccggcgtctgggtcatagcccacgagtgcggccaccacgccttcagcgactac

SEQ ID NO: 2662 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctggcctctctactgggcctgccaagggtgcgtcctaaccggcgtctgggtcatagcccacgagtgcggccaccacgccttcagcgactac

SEQ ID NO: 2663 - DNA, 404 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgtgacaccgcccttcactgtcggagaactcaagaaagcaatcccaccgcactgtttcaaacgctcgatccctcgctctttctcctacctcatctggaacatcatcatagcctcctgcttctactacgtccccaccacttacttccctctcctccctcaccctctctcctacttcgcttccccccatcgtggctggcgatggccaccacctgctccggggtcaagccgtgggcctctctactgggcctgccagggctgcgtcctaaccggcgtctgggtcatagcccacgagtgcggccaccacgccttcagcgactac

SEQ ID NO: 2664 - DNA, 332 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggaactgccaagggtgcgtcctaaccggcgtctgggtcatagcccacgagtgcggccaccacgccttcagcgactac

SEQ ID NO: 2665 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaacgggcctctgggtcatcgcccacgaatgcggccaccacgccttcagcgactac

SEQ ID NO: 2666 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctggcctctctactgggcctgccaagggtgcgtcctaaccggcgtctgggtcatagcccacgagtgcggccaccacgccttcagcgactac

SEQ ID NO: 2667 - DNA, 342 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagccccctgcttctactacgtcgccaccgcttacttccctctcctccctcaccctctctcctacttctctactgggcctgccagggctgcgtcctaaccggcgtctgggtcatagcccacgagtgcggccaccacgcctcagcgactac

SEQ ID NO: 2668 - DNA, 340 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccagggctgcgtcctaacgggcctctgggtcatagcccacgagtgcggccaccacgccttcagcgactac

SEQ ID NO: 2669 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacacagcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttccctctctactgggcctgccagggctgcgtcctaaccggcgtctgggtcatagcccacgagtgcggccaccacgccttcagcgactac

SEQ ID NO: 2670 - DNA, 339 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctggcctctctactgggcctgccaagggtgcgtcctaaccggcgtctgggtcatagcccacgagtgcggccaccacgccttcagcgactac

SEQ ID NO: 2671 - DNA, 342 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcgcctggcctctctactgggcctgccagggctgcgtcctaaccggcgtctgggtcatagcccacgagtgcggccaccacgccttcagcgactac

SEQ ID NO: 2672 - DNA, 340 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgctagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctactctactgggcctgccagggctgcgtcctaaccggcgtctgggtcatagcccacgagtgcggccaccacgccttcagcgactac

SEQ ID NO: 2673 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcttacctcatctgggacatcatcatagcctcctgcttctactacgtcgccaccacttacttccctctcctccctcaccctctctcctactggcctctctactgggcctgccagggctgcgtcctaaccggcgtctgggtcatagcccacgagtgcggccaccacgccttcagcgactac

SEQ ID NO: 2674 - DNA, 357 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccgccgcactgtttcaaacgctcgattcctcgctctttctcctacctcatctgggacatcatcatagcctcctgcttctactacgtcgccaccacttacttccctctcctccctcaccctctctcctacttcgcgcgcctggcctctctactgggcctgcccgggccgcgccctaaccggcgtctgggtcatagcccacgagcgcggccaccacgccttcagcgcctac

SEQ ID NO: 2675 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgagtgcggccaccacgccttcagcgactac

SEQ ID NO: 2676 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccagggctgcgtcctaaccggcgtctgggtcatagcccacgagtgcggccaccacgccttcagcgactac

SEQ ID NO: 2677 - DNA, 340 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttactgggcctgccagggctgcgtcctaaccggcgtctgggtcatagcccacgagtgcggccaccacgccttcagcgactac

SEQ ID NO: 2678 - DNA, 342 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttctactgggcctgccagggctgcgtcctaaccggcgtctgggtcatagcccacgagtgcggccaccacgccttcagcgactac

SEQ ID NO: 2679 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccagggctgcgtcctaaccggcgtctgggtcatagcccacgagtgcggccaccacgccttcagcgactac

SEQ ID NO: 2680 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggccatagcccacgagtgcggccaccacgccttcagcgactac

SEQ ID NO: 2681 - DNA, 335 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccagggctgcgtcctaaccggcgtctgggtcatagcccacgagtgcggccaccacgccttcagcgactac

SEQ ID NO: 2682 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggggcctctctactgggcctgccaagggtgcgtcctaaccggcgtctgggtcatagcccacgagtgcggccaccacgccttcagcgactac

SEQ ID NO: 2683 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccaagggtgcgtcctaaccggcgtctgggtcatagcccacgagtgcggccaccacgccttcagcgactac

SEQ ID NO: 2684 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcacactctctcctcctttggcctctctactgggcctgccaagggtgcgtcctaaccggcgtctgggtcatagcccacgagtgcggccaccacgccttcagcgactac

SEQ ID NO: 2685 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttccctctctactgggcctgccagggctgcgtcctaaccggcgtctgggtcatagcccacgagtgcggccaccacgccttcagcgactac

SEQ ID NO: 2686 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgagtgcggccaccacgccttcagcgactac

SEQ ID NO: 2687 - DNA, 342 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcgtagcctcctgcttctactacgtcgccaccacttacttccctctcctccctcaccctctctcctactctctactgggcctgccaagggtgcgtcctaaccggcgtctgggtcatagcccacgagtgcggccaccacgccttcagcgactac

SEQ ID NO: 2688 - DNA, 347 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 2689 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcggcctctctactgggcctgccagggctgcgtcctaaccggcgtctgggtcatagcccacgagtgcggccaccacgccttcagcgactac

SEQ ID NO: 2690 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccagggctgcgtcctaaccggcgtctgggtcatagcccacgagtgcggccaccacgccttcagcgactac

SEQ ID NO: 2691 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccctggcctctctactgggcctgccagggctgcgtcctaaccggcgtctgggtcatagcccacgagtgcggccaccacgccttcagcgactac

SEQ ID NO: 2692 - DNA, 342 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccaaggctgcgtcctaacgggcctctgggtcatcgcccacgagtgcggccaccacgccttcagcgactac

SEQ ID NO: 2693 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggcctgccagggctgcgtcctaaccggcgtctgggtcatagcccacgagtgcggccaccacgccttcagcgactac

SEQ ID NO: 2694 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttggcctctctactgggcctgccagggctgcgtcctaaccggcgtctgggtcatagcccacgagtgcggccaccacgccttcagcgactac

SEQ ID NO: 2695 - DNA, 340 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttactgggcctgccaagggtgcgtcctaaccggcgtctgggtcatagcccacgagtgcggccaccacgccttcagcgactac

SEQ ID NO: 2696 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccctggcctctctactgggcctgccaagggtgcgtcctaaccggcgtctgggtcatagcccacgagtgcggccaccacgccttcagcgactac

SEQ ID NO: 2697 - DNA, 415 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttcccactcctccctcaccctctcgcctacttcgctggagacgatggccaccacctgctggggggtcaagttgagcggggcacccgtcagtgcatgcatggcctctctacggggcctgccagggctgcgtcctaaccggcgtctgggtcatagcccacgagtgcggccaccacgccttcagcgactac

SEQ ID NO: 2698 - DNA, 346 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctccatccctcgctccttctcctacctcatctgggacatcatcatagcctcctgcttctactacgtcgccaccacttacttccctctcctccctcaccatctctcctacttcctctctactgggcctgccagggctgcgtcctaaccggcgtctgggtcatagcccacgagtgcggccaccacgccttcagcgactac

SEQ ID NO: 2699 - DNA, 337 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattactgggcctgccagggctgcgtcctaaccggcgtctgggtcatagcccacgagtgcggccaccacgccttcacgactac

SEQ ID NO: 2700 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccggcctctctactgggcctgccagggctgcgtcctaaccggcgtctgggtcatagcccacgagtgcggccaccacgccttcagcgactac

SEQ ID NO: 2701 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccagggctgcgtcctaaccggcgtctgggtcatagcccacgagtgcggccaccacgccttcagcgactac

SEQ ID NO: 2702 - DNA, 429 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacttcgggcgtcctgcccgcccccctccgggccgttgcttcacaccatcgtggctggcgatggccgccacctgctccggggtcatggcctctctactgggcctgccagggctgcgtcctaaccggcgtctgggtcatagcccacgagtgcggccaccacgccttcagcgactac

SEQ ID NO: 2703 - DNA, 349 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 2704 - DNA, 378 bp, Artificial
  Mutation in BnaA.FAD2.a introduced by TALE nuclease pair BnFAD2_T01
caggatccatgggtgcaggtggaagaatgcaagtgtctcatccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctttgatccggttcctgaacaggatctatttgatggcctctctactgggcctgccaagggtgcgtcctaaccggcgtctgggtcatagcccacgagtgcggccaccacgccttcagcgactac

SEQ ID NO: 2705 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctcggcctctctactgggcctgccaagggtgcgtcctaaccggcgtctgggtcatagcccacgaatgcggccaccacgccttcagcgactac

SEQ ID NO: 2706 - DNA, 303 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtcccctgcgagacaccaccattcactctcggagacctcaagaaagcaatcccacctcactgcttcaaacgctccatcccacgctccttctcctcttcgacatcatcatctcctcctcggctcctccctcaccctctctcctctctactgggcctgccaagggtgcgtcctaaccggcgtctgggtcatagcccacgagtgcggccaccacgccttcagcgactac

SEQ ID NO: 2707 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccagggctgcgtcctaaccggcgtctgggtcatagcccacgagtgcggccaccacgccttcagcgactac

SEQ ID NO: 2708 - DNA, 352 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggcctctctactgggcctgccagggctgcgtcctaaccggcgtctgggtcatagcccacgagtgcggccaccacgccttcagcgactac

SEQ ID NO: 2709 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctactgggcctgccaagggtgcgtcctaaccggcgtctgggtcatagcccacgagtgcggccaccacgccttcagcgactac

SEQ ID NO: 2710 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatcccttgctctttctcctacctcatctgggacatcatcatagcctcctgcttctactacgtcgccaccacttacttccctctcctccctcaccctctctcctactggcctctctactgggcctgccagggctgcgtcctaaccggcgtctgggtcatagcccacgagtgcggccaccacgccttcagcgactac

SEQ ID NO: 2711 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccagggctgcgtcctaaccggcgtctgggtcatagcccacgagtgcggccaccacgccttcagcgactac

SEQ ID NO: 2712 - DNA, 334 bp, Artificial
  Mutation in BnaA.FAD2.a introduced by TALE nuclease pair BnFAD2_T01
caggatccatgggtgcaggtggaagaatgcaagtgtctcctccatccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcacccactctctactgggcctgccagggctgcgtcctaaccggcgtctgggtcatagcccacgagtgcggccaccacgccttcagcgactac

SEQ ID NO: 2713 - DNA, 329 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgccaagggtgcgtcctaaccggcgtctgggtcatagcccacgagtgcggccaccacgccttcagcgactac

SEQ ID NO: 2714 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctggcctctctactgggcctgccagggctgcgtcctaaccggcgtctgggtcatagcccacgagtgcggccaccacgccttcagcgactac

SEQ ID NO: 2715 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcctctctactgggcctgccagggctgcgtcctaaccggcctctgggtcatagcccacgagtgcggccaccacgccttcagcgactac

SEQ ID NO: 2716 - DNA, 277 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacgccttcagctactac

SEQ ID NO: 2717 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccagggctgcgtcctaacgggcctctgggtcatcgcccacgaatgcggccaccacgccttcagcgactac

SEQ ID NO: 2718 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccagggctgcgtcctaaccggcgtctgggtcatagcccacgagtgcggccaccacgccttcagcgactac

SEQ ID NO: 2719 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccaagggtgcgtcctaaccggcgtctgggtcatagcccacgagtgcggccaccacgccttcagcgactac

SEQ ID NO: 2720 - DNA, 345 bp, Artificial
  Mutation in BnaA.FAD2.a introduced by TALE nuclease pair BnFAD2_T01
caggatccatgggtaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccagggctgcgtcctaaccggcgtctgggtcatagcccacgagtgcggccaccacgccttcagcgactac

SEQ ID NO: 2721 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctaccacctctccacagcctacttccctctcctcccccaccctctctcctacctctctactgggcctgccagggctgcgtcctaacgggcctctgggtcatagcccacgagtgcggccaccacgccttcagcgactac

SEQ ID NO: 2722 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccagggctgcgtcctaaccggcgtctgggtcatagcccacgagtgcggccaccacgccttcagcgactac

SEQ ID NO: 2723 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccagggctgcgtcctaaccggcgtctgggtcatagcccacgagtgcggccaccacgccttcagcgactac

SEQ ID NO: 2724 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgcaaccacttacttccctctcctccctcaccctctctcctaggcctctctactgggcctgccagggctgcgtcctaaccggcgtctgggtcatagcccacgagtgcggccaccacgccttcagcgactac

SEQ ID NO: 2725 - DNA, 339 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccggcctgccagggctgcgtcctaaccggcgtctgggtcatagcccacgagtgcggccaccacgccttcagcgactac

SEQ ID NO: 2726 - DNA, 348 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 2727 - DNA, 356 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgccgcctggcctctctactgggcctgccaagggtgcgtcctaaccggcgtctgggtcatagcccacgagtgcggccaccacgccttcagcgactac

SEQ ID NO: 2728 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctccttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 2729 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccaacttggcctctctactgggcctgccaagggtgcgtcctaaccggcctctgggtcatagcccacgagtgcggccaccacgccttcagcgactac

SEQ ID NO: 2730 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccatcaccctctctcctacttggcctctctactgggcctgccagggctgcgtcctaaccggcgtctgggtcatagcccacgagtgcggccaccacgccttcagcgactac

SEQ ID NO: 2731 - DNA, 354 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccttggcctctctactgggcctgccagggctgcgtcctaaccggcgtctgggtcatagcccacgaatgcggccaccacgccttcagcgactac

SEQ ID NO: 2732 - DNA, 352 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctactccgctggcctctctactgggcctgccagggctgcgtcctaaccggcgtctgggtcatagcccacgagtgcggccaccacgccttcagcgactac

SEQ ID NO: 2733 - DNA, 401 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactacttcgccataaactgccaggcatcaaactaagcagaaggccatccgtccataggctggcctctctactgggcctgccaagggtgcgtcctaaccggcgtctgggtcatagcccacgagtgcggccaccacgccttcagcgactac

SEQ ID NO: 2734 - DNA, 300 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtctctctactgggcctgccaagggtgcgtcctaaccggcgtctgggtcatagcccacgagtgcggccaccacgccttcagcgactac

SEQ ID NO: 2735 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaacgggcctctgggtcatagcccacgagtgcggccaccacgccttcagcgactac

SEQ ID NO: 2736 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaacgggcctctgggtcatagcccacgagtgcggccaccacgccttcagcgactac

SEQ ID NO: 2737 - DNA, 439 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaacccaagaaagcaatcccaccgcactgtttcaaacgctcgatccctcgctctttctcctacctcatctgggacatcatcatagcctcctgcttctactacgtcgccaccacttacttccctctcctccctcaccctctctcctaggtccagcgcctgcttgccgccatcgtggctggcgatggccaccacctgctccggggtcaagccgtgggcctggcacagcaccggcaagcaggcgctgtctctactgggcctgccagggctgcgtcctaaccggcgtctgggtcatagcccacgaatgcggccaccacgccttcagcgactac

SEQ ID NO: 2738 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgccctttactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctaaccggcgtctgggtcatagcccacgagtgcggccaccacgccttcagcgactac

SEQ ID NO: 2739 - DNA, 345 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctccttctcctacctcatctgggacatcatcatagcctcctgcttctactacgtcgccaccacttacttccctctcctccctcaccctctctcctaggcctctctactgggcctgccagggctgcgtcctaaccggcgtctgggtcatagcccacgagtgcggccaccacgccttcagcgactac

SEQ ID NO: 2740 - DNA, 329 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgggcctgccagggctgcgtcctaaccggcgtctgggtcatagcccacgagtgcggccaccacgccttcagcgactac

SEQ ID NO: 2741 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccagggctgcgtcctaaccggcgtctgggtcatagcccacgagtgcggccaccacgccttcagctactac

SEQ ID NO: 2742 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccggcctctctactgggcctgccaagggtgcgtcctaaccggcgtctgggtcatagcccacgagtgcggccaccacgccttcagcgactac

SEQ ID NO: 2743 - DNA, 344 bp, Artificial
  Mutation in BnaA.FAD2.a introduced by TALE nuclease pair BnFAD2_T01
caggatccatgggtgcaggtggaagaatgtaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccagggctgcgtcctaaccggcgtctgggtcatagcccacgagtgcggccaccacgccttcagcgactac

SEQ ID NO: 2744 - DNA, 332 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccagggctgcgtcctaaccggcgtctgggtcatagcccacgagtgcggccaccacgccttcagcgactac

SEQ ID NO: 2745 - DNA, 345 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatccaaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccagggctgcgtcctaaccggcgtctgggtcatagcccacgagtgcggccaccacgccttcagcgactac

SEQ ID NO: 2746 - DNA, 339 bp, Artificial
  Mutation in BnaA.FAD2.a introduced by TALE nuclease pair BnFAD2_T01
caggatctatgggtgcaggtggaagaatgcaagtgcatcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctggcctctctactgggcctgccaagggtgcgtcctaaccggcgtctgggtcatagcccacgagtgcggccaccacgccttcagcgactac

SEQ ID NO: 2747 - DNA, 334 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacatacttccctctcctccctcaccctctctctactgggcctgccagggctgcgtcctaaccggcgtctgggtcatagcccacgagtgcggccaccacgccttcagcgactac

SEQ ID NO: 2748 - DNA, 335 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacacaatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcctctctactgggcctgccagggctgcgtcctaaccggcgtctgggtcatagcccacgagtgctgccaccacgccttcagcgactac

SEQ ID NO: 2749 - DNA, 348 bp, Artificial
  Mutation in BnaA.FAD2.a introduced by TALE nuclease pair BnFAD2_T01
caggatccatgtgtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 2750 - DNA, 348 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 2751 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccagggctgcgtcctaaccggcgtctgggtcatagcccacgagtgcggccaccacgccttcagcgactac

SEQ ID NO: 2752 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaaggctgcgtcctaacgggcctctgggtcatcgcccacgaatgcggccaccacgccttcagcgactac

SEQ ID NO: 2753 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcgcctggcctctctactgggcctgccagggctgcgtcctaaccggcgtctgggtcatagcccacgagtgcggccaccacgccttcagcgactac

SEQ ID NO: 2754 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccggcctctctactgggcctgccagggctgcgtcctaaccggcgtctgggtcatagcccacgagtgcggccaccacgccttcagcgactac

SEQ ID NO: 2755 - DNA, 389 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccacccccgtataaaccgtcgatgccctgctgaatattgaactgaaccaggcgactggcctctctactgggcctgccaagggtgcgtcctaacgggcctctgggtcatagcccacgagtgcggccaccacgccttcagcgactac

SEQ ID NO: 2756 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaacctacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccatgagtgcggccaccacgccttcagcgactac

SEQ ID NO: 2757 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcggaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagggcctctctactaggcctgccaagggtgcgtcctaaccggcgtctgggtcatagcccacgagtgcggccaccgcgccttcagcgactac

SEQ ID NO: 2758 - DNA, 339 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctactgggcctgccaagggtgcgtcctaaccggcgtctgggtcatagcccacgagtgcggccaccacgccttcagcgactac

SEQ ID NO: 2759 - DNA, 386 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggccaccacctgctggggggtcaagccgtgggcctggcacagtctctactgggcctgccagggctgcgtcctaacgggcctctgggtcatcgcccacgaatgcggccaccacgccttcagcgactac

SEQ ID NO: 2760 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccactagtgcggccaccacgccttcagcgactac

SEQ ID NO: 2761 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctgggcctctctactgggcctgccaagggtgcgtcctaaccggcgtctgggtcatagcccacgagtgcggccaccacgccttcagcgactac

SEQ ID NO: 2762 - DNA, 349 bp, Artificial
  Mutation in BnaA.FAD2.a introduced by TALE nuclease pair BnFAD2_T01
caggatccatgggtgcaggtggaagaatgcaagtgtctcctccctcccaaaagtctgaaaccgacaacatcaagcgcgtaccctgcgagacaccgcccttcactgtcggagaactcaagaaagcaatcccaccgcactgcttcaaacgctccatccctcgctccttctcctacctcctcttcgacatcctcgtctcctcctccctctaccacctctccacagcctacttccctctcctcccccaccctctctcctactttggcctctctactgggcctgccagggctgcgtcctaaccggcgtctgggtcatagcccacgagtgcggccaccacgccttcagcgactac

SEQ ID NO: 2763 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctttggcctctctactgggcctgccaagggtgcgtcctaacgggcctctgggtcatcgcccacgaatgcggccaccacgccttcagcgactac

SEQ ID NO: 2764 - DNA, 405 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcccgcgccatgctctgccggctgccccgctcaacttgaccccccagcaggtggtggccatcggcctctctactgggcctgccaagggtgcgtcctaaccggcgtctgggtcatagcccacgagtgcggccaccacgccttcagcgactac

SEQ ID NO: 2765 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 2766 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcgtagcctcctgcttctactacgtcgccaccacttacttccctctcctcccccaccctctcccttacctggcccctctactgggcctgccagggctgcgtcctaaccggcgtctgggtcatagcccacgagtgcggccaccacgccttcagcgactac

SEQ ID NO: 2767 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctcggctcctccctctaccacctctccacagcctacttccctctcccttacctcgccctggcccctctacggggcctgccaaggctgcgtcctaacgggcctctgggtcatagcccacgagtgcggccaccacgccttcagcgactac

SEQ ID NO: 2768 - DNA, 339 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttactgggcctgccagggctgcgtcctaacgggcctctgggtcatcgcccacgaatgcggccaccacgccttcagcgactac

SEQ ID NO: 2769 - DNA, 331 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcaccgggcctgccagggctgcgtcctaaccggcgtctgggtcatagcccacgagtgcggccaccacgccttcagcgactac

SEQ ID NO: 2770 - DNA, 329 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctgggcctgccagggctgcgtcctaaccggcgtctgggtcatagcccacgagtgcggccaccacgccttcagcgactac

SEQ ID NO: 2771 - DNA, 441 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgggtggccatcgccagccacgatggcggcaagcaggcgctggagacggtccagcggctgttgccggtgctgtgccaggcccacggcttgacccctggcctctctactgggcctgccaagggtgcgtcctaaccggcgtctgggtcatagcccacgagtgcggccaccacgccttcagcgactac

SEQ ID NO: 2772 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 2773 - DNA, 349 bp, Artificial
  Mutation in BnaA.FAD2.a introduced by TALE nuclease pair BnFAD2_T01
caggatccatgggtgcaggtgggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 2774 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccagggctgcgtcctaaccggcgtctgggtcatagcccacgagtgcggccaccacgccttcagcgactac

SEQ ID NO: 2775 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcgcctctctactgggcctgccagggctgcgtcctaaccggcgtctgggtcatagcccacgagtgcggccaccacgccttcagcgactac

SEQ ID NO: 2776 - DNA, 332 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccaaggctgcgtcctaacgggcctctgggtcatagcccacgagtgcggccaccacgccttcagcgactac

SEQ ID NO: 2777 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccagggctgcgtcctaaccggcgtctgggtcatagcccacgagtgcggccaccacgccttcagcgactac

SEQ ID NO: 2778 - DNA, 342 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctctctactgggcctgccagggctgcgtcctaaccggcgtctgggtcatagcccacgagtgcggccaccacgccttcagcgactac

SEQ ID NO: 2779 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctttggcctctctactgggcctgccaagggtgcgtcctaaccggcgtctgggtcatagcccacgagtgcggccaccacgccttcagcgactac

SEQ ID NO: 2780 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctcaccggcgtctgggtcatagcccacgagtgcggccaccacgccttcagcgactac

SEQ ID NO: 2781 - DNA, 340 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccagggctgcgtcctaaccggcgtctgggtcatagcccacgagtgcggccaccacgccttcagcgactac

SEQ ID NO: 2782 - DNA, 341 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgggcctgccagggctgcgtcctaaccggcgtctgggtcatagcccacgagtgcggccaccacgccttcagcgactac

SEQ ID NO: 2783 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccaaggctgcgtcctaacgggcctctgggtcatcgcccacgaatgcggccaccacgccttcagcgactac

SEQ ID NO: 2784 - DNA, 401 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttcccttgcctcgggcatccaagcagcaagcgcgttacgccgtgggtcgatgtttgactggcccctctactgggcctgccaaggctgcgtcctaacggccctctgtgtcatcgcccacgaatgcggccaccacgccttcagcgactac

SEQ ID NO: 2785 - DNA, 350 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 2786 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaacgggcctctgggtcatagcccacgagtgcggccaccacgccttcagcgactac

SEQ ID NO: 2787 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctggcctctctactgggcctgccaagggtgcgtcctaaccggcgtctgggtcatagcccacgagtgcggccaccacgccttcagcgactac

SEQ ID NO: 2788 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgcccccacttacttccctctcctccctcaccctctctcctaccgcgtggcctctctactgggcctgccaaggctgcgtcctaaccggcgtctgggtcatagcccacgagtgcggccaccacgccttcagcgactac

SEQ ID NO: 2789 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctctctactgggcctgccagggctgcgtcctaaccggcgtctgggtcatagcccacgagtgcggccaccacgccttcagcgactac

SEQ ID NO: 2790 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagcctgaaaccgacaacctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgccgccaccacttacttccctctcctccctcaccctctctcccatggcctctctactgggcctgccaagggtgcgtcctaaccggcgtctgggtcatagcccacgagtgcggccaccacgccttcagcgactac

SEQ ID NO: 2791 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgcctctctactgggcctgccagggctgcgtcctaaccggcgtctgggtcatagcccacgagtgcggccaccacgccttcagcgactac

SEQ ID NO: 2792 - DNA, 338 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattactgggcctgccagggctgcgtcctaaccggcgtctgggtcatagcccacgagtgcggccaccacgccttcagcgactac

SEQ ID NO: 2793 - DNA, 342 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacattaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtagccaccacttacttccctctcctccctcaccctctctcctactctctactgggcctgccagggctgcgtcctaaccggcgtctgggtcatagcccacgagtgcggccaccacgccttcagcgactac

SEQ ID NO: 2794 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctagcctctctactgggcctgccaagggtgcgtcctaaccggcgtctgggtcatagcccacgagtgcggccaccacgccttcagcgactac

SEQ ID NO: 2795 - DNA, 338 bp, Artificial
  Mutation in BnaA.FAD2.a introduced by TALE nuclease pair BnFAD2_T01
caggatccatgggtgcaggtggaagaatgcaagtgtctcctccctccaaaaagactgaaaccgacaacagcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccctctctactgtacttgccgagggtgccagatatccggcgtctgcgtcatagcccaccagtgcctcccccacggcttctgcgactac

SEQ ID NO: 2796 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgccgccaccacgccttcagcgactcc

SEQ ID NO: 2797 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccagggctgcgtcctaaccggcgtctgggtcatagcccacgagtgcggccaccacgccttcagcgactac

SEQ ID NO: 2798 - DNA, 342 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctgcctctctactgggcctgccaagggtgcgtcctaaccggcgtctgggtcatagcccacgagtgcggccaccacgccttcagcgactac

SEQ ID NO: 2799 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcccacttagcctctctactgggccggtcagcactgcgtcctaaccggcgtcgaggtcatatcccacgagtgctgccaccacgccatcagcgactac

SEQ ID NO: 2800 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcggcctctctactgggcctgccaagggtgcgtcctaaccggcgtctgggtcatagcccacgagtgcggccaccacgccttcagcgactac

SEQ ID NO: 2801 - DNA, 351 bp, Artificial
  Mutation in BnaA.FAD2.a introduced by TALE nuclease pair BnFAD2_T01
caggatccatggtgcaggtggaagaatgcaagtgtatcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccgccctggcctctctactgggcctgccagggctgcgtcctaaccggcgtctgggtcatagcccacgagtgcggccaccacgccttcagcgactac

SEQ ID NO: 2802 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccagggctgcgtcctaaccggcgtctgggtcatagcccacgagtgcggccaccacgccttcagcgactac

SEQ ID NO: 2803 - DNA, 350 bp, Artificial
  Mutation in BnaA.FAD2.a introduced by TALE nuclease pair BnFAD2_T01
caggatccatgggtgcaggtggaagaatgcaagtgtctcctccatccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctcgcctctctactgggcctgccagggctgcgtcctaaccggcgtctgggtcatagcccacgagtgcggccaccacgccttcagcgactac

SEQ ID NO: 2804 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctggcctctctactgggcctgccagggctgcgtcctaaccggcgtcggggtcatagcccgcgagtgcggccaccacgccttcagcgactac

SEQ ID NO: 2805 - DNA, 332 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgccgccacctcttccttccctctcctccctcaccctctctactgggcctgccaagggtgcgtcctaaccggcgtctgggtcatagcccacgagtgcggccaccacgccttcagcgactac

SEQ ID NO: 2806 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccagggctgcgtcctaaccggcgtctgggtcatagcccacgagtgcggccaccacgccttcagcgactac

SEQ ID NO: 2807 - DNA, 331 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgggcctgccagggctgcgtcctaaccggcgtctgggtcatagcccacgagtgcggccaccacgccttcagcgactac

SEQ ID NO: 2808 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcccctggcctctctactgggcctgccagggctgcgtcctaaccggcgtctgggtcatagcccacgagtgcggccaccacgccttcagcgactac

SEQ ID NO: 2809 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcatctctactgggcctgccaagggtgcgtcctaaccggcgtctgggtcatagcccacgagtgcggccaccacgccttcagcgactac

SEQ ID NO: 2810 - DNA, 356 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccagggctgcgtcctaaccggcgtctgggtcatagcccacgagtgcggccaccacgccttcagcgactac

SEQ ID NO: 2811 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccagggctgcgtcctaaccggcgtcggggtcatagcccacgagtgcggccaccacgccttcagcgactac

SEQ ID NO: 2812 - DNA, 329 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgggcctgccagggctgcgtcctaaccggcgtcggggtcatagcccacgagtgcggccaccacgccgtcagcgactac

SEQ ID NO: 2813 - DNA, 332 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccagggctgcgtcctaaccggcgtctgggtcatagcccacgagtgcggccaccacgccttcagcgactac

SEQ ID NO: 2814 - DNA, 339 bp, Artificial
  Mutation in BnaA.FAD2.a introduced by TALE nuclease pair BnFAD2_T01
caggatccatgggtgcaggtggaagaatgcaagtgtctcctccctcccaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccggcctgccagggctgcgtcctaaccggcgtctgggtcatagcccacgagtgcggccaccacgccttcagcgactac

SEQ ID NO: 2815 - DNA, 342 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgctgctactacgtcgccacctcttactcccctctcctccctccccctcgctcctactctctactgggccggccagggctgcgtcctaaccggcgtctgggtcatagcccacgagtgcggccaccacgccttcagcgactac

SEQ ID NO: 2816 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcattgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 2817 - DNA, 349 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 2818 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacaggcctctctactgggcctgccagggctgcgtcctaaccggcgtctgggtcatagcccacgagtgcggccaccacgccttcagcgactac

SEQ ID NO: 2819 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctggcctctctactgggcctgcaagggctgcgtcctaacgggcctctgggtcatcgcccaccaatgcggccaccacgccctcagcgactac

SEQ ID NO: 2820 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaaccggcttctgggtcatagcccacgagtgcggccaccacgccttcagcgactac

SEQ ID NO: 2821 - DNA, 389 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccacccacgtataaaccgtcgatgccctgctgaatattgaactgaaccaggcgactggcctctctactgggcctgccaagggtgcgtcctaaccggcgtctgggtcatagcccacgagtgcggccaccacgccttcagcgactac

SEQ ID NO: 2822 - DNA, 348 bp, Artificial
  Mutation in BnaA.FAD2.a introduced by TALE nuclease pair BnFAD2_T01
caggatccatgggtgcaggtggaagaatgcaagtgtctcctccctcccaaaagtctgaaaccgacaacatcaagcgcgtaccctgctagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcgcacgattgcggccaccacgccatcagcgactac

SEQ ID NO: 2823 - DNA, 398 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgccaacttctcaagattgcaaaacgtggcggcgtgaccgcagtggaggcagtgcatgcgcctctctactgggcctgccaagggtgcgtcctaaccggcgtctgggtcatagcccacgagtgcggccaccacgccttcagcgactac

SEQ ID NO: 2824 - DNA, 339 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttactgggcctgccagggctgcgtcctaaccggcgtctgggtcatagcccacgagtgcggccaccacgccttcagcgactac

SEQ ID NO: 2825 - DNA, 334 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctctactgggcctgccagggctgcgtcctaaccggcgtctgggtcatagcccacgagtgcggccaccacgccttcagcgactac

SEQ ID NO: 2826 - DNA, 351 bp, Artificial
  Mutation in BnaA.FAD2.a introduced by TALE nuclease pair BnFAD2_T01
caggatccatgggtgcaggttggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctggcctctctactgggcctgccagggctgcgtcctaaccggcgtctgggtcatagcccacgagtgcggccaccacgccttcagcgactac

SEQ ID NO: 2827 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgagtgcggccaccacgccttcagcgactac

SEQ ID NO: 2828 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccatcaccctctctcctacttcctctctactgggcctgccagggctgcgtcctaaccggcgtctgggtcatagtccacgagtgcggccaccacgccttcagcgactac

SEQ ID NO: 2829 - DNA, 356 bp, Artificial
  Mutation in BnaA.FAD2.a introduced by TALE nuclease pair BnFAD2_T01
caggatccatgggagcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccagggctgcgtcctaacgggcctctgggtcatcgcccacgaatgcggccaccacgccttcagcgactac

SEQ ID NO: 2830 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgaatgcggccaccacgccgtcagcgactac

SEQ ID NO: 2831 - DNA, 450 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttcgctctcctccctcaccctctctcctacttcgaaaacggcttgtcccgcgtcatcggcgggggtcataacgtgactcccttaaggcagtgcatgcatggcgcaatgcactgacgggtgccccgctcaactttggcctctctactgggcctgccagggctgcgtcctaacgggcctctgggtcatagcccacgagtgcggccaccacgccttcagcgactac

SEQ ID NO: 2832 - DNA, 300 bp, Artificial
  Mutation in BnaA.FAD2.a introduced by TALE nuclease pair BnFAD2_T01
caggatccatgggtgcaggtggaagaatgcaagtgcctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtctctctactgggcctgccaagggtgcgtcctaaccggcgtctgggtcatagcccacgagtgcggccaccacgccttcagcgactac

SEQ ID NO: 2833 - DNA, 348 bp, Artificial
  Mutation in BnaA.FAD2.a introduced by TALE nuclease pair BnFAD2_T01
caggatccatgggtgcaggtggaagaatgcaagtgtctcctccccccaaaaagtctgaaaacgacaacatcaagcgcgtaccctgcgagacaccgcccttcactgtctgagaactcaagaaagcaatcccaccgcactgtttcaaacgctcgatccctcgctctttctcctacctcatctgggacatcatcatagcctcctgcttctactacgtcgccaccacttacgtccctctcctccctcaccctctctccgacttagcctctctactcggccggccagggctgcgtcctaaccggcgtctgggtcatagcccaccagtgctgccaccacgccatcatcgactac

SEQ ID NO: 2834 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtccgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccatcaccctctctcctacttggcctctctactgggcctgccagggctgcgtcctaaccggcgtctgggtcatagcccacgagtgcggccaccacgccttcagcgactac

SEQ ID NO: 2835 - DNA, 345 bp, Artificial
  Mutation in BnaA.FAD2.a introduced by TALE nuclease pair BnFAD2_T01
caggatccatgggttcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctactcctctctactgggcctgccaagggtgcgtcctaaccggcgtctgggtcatagcccacgagtgcggccaccacgccttcagcgactac

SEQ ID NO: 2836 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctcttcgacatcatcatctcctcctcggctcctccctctaccacctctccacagcctacttccctctcctcccccaccctctccctccctctactgggcctgccaaggctgcgtcctaacgggcctctgggtcatcgcccacgaatgcggccaccacgccttcagcgactac

SEQ ID NO: 2837 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctagcctctctactgggcctgccaagggtgcgtcctaaccggcgtctgggtcatagcccacgagtgcggccaccacgccttcagcgactac

SEQ ID NO: 2838 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttccctctctactgggcctgccagggctgcgtcctaaccggcgtctgggtcatagcccacgagtgcggccaccacgccttcagcgactac

SEQ ID NO: 2839 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgaccac

SEQ ID NO: 2840 - DNA, 351 bp, Artificial
  Mutation in BnaA.FAD2.a introduced by TALE nuclease pair BnFAD2_T01
caggatccatgggtgcaggtggaagaatgcaagtgactcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggccggccagggctgcgtcctaaccggcgtcggggtcatagcccacgagtgcggccaccacgccttcagcgactac

SEQ ID NO: 2841 - DNA, 339 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccggcctgacagggctgcgtcctaaccggcgtctgggtcatagcccacgagtgcggccaccacgccttcagcgactac

SEQ ID NO: 2842 - DNA, 334 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccaagggtgcgtcctaaccggcgtctgggtcatagcccacgagtgcggccaccacgccttcagcgactac

SEQ ID NO: 2843 - DNA, 354 bp, Artificial
  Mutation in BnaA.FAD2.a introduced by TALE nuclease pair BnFAD2_T01
caggatccatgggtgcaggtggaagaatgcaagtgtctcctccctccaaaaagcctgaaaccgacaacatcaagcgcgtaccctgcgagacaccgcccttcactgtcgtagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctccgcctggcccctctactgggcctgccaaggctgcgtcctaacgggcctctgggtcatcgcccacgaatgcggccaccacgccttcagcgactac

SEQ ID NO: 2844 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatccaaccgcactgtttcaaacgctcgatccctcgctctttctcctacctcatctgggacatcatcatagcctcctgcttctactacgtcgccaccacttacttccctctcctccctcaccctctcccctacctctctactgggcctgccagggctgcgtcctaaccggcgtctgggtcatagcccacgagtgcggccaccacgccttcagcgactac

SEQ ID NO: 2845 - DNA, 354 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaactctcgatccctcgctctttctcctacctcatctgggacatcatcatagcctcctgcttctactacgtcgccaccacttacttccctctcctccctcaccctctctcctacttcgtggtggcctctctactgggcctgccaagggtgcgtcctaaccggcgtctgggtcatagcccacgagtgcggccaccacgccttcagcgactac

SEQ ID NO: 2846 - DNA, 329 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgggcctgccagggctgcgtcctagccggcgtctgggtcatagcccacgagtgcggccaccacgccttcagcgactac

SEQ ID NO: 2847 - DNA, 325 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggctgcgtcctaaccggcgtctgggtcatagcccacgagtgcggccaccacgccttcagcgactac

SEQ ID NO: 2848 - DNA, 342 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccaagggtgcttcctaaccggcgtcggggtcatagcccgcgagtgcggccaccacgccttcagcgactac

SEQ ID NO: 2849 - DNA, 350 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctggcctctctactgggcctgccaggcctgcgtcctaacgggcctctgggtcatagcccgcgagtgcggccaccacgccatcagcgactac

SEQ ID NO: 2850 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccagggctgcgtcctaaccggcgtctgggtcatagcccacgagtgcggccaccacgccttcagcgactac

SEQ ID NO: 2851 - DNA, 433 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatccctcgctccttctcctacctcctcttcgacatcctcgtctcctcctccctctaccacctctccacagcctacttccctctcctccctcaccctcggctgttgccggtgctgtgccaggcccacggcttgaccccccagcaggtggtggccatcgccagcaatggcggtggcaacagccgctggaggcctggcctctctactgggcctgccagggctgcgtcctaaccggcgtctgggtcatagcccacgagtgcggccaccacgccttcagcgactac

SEQ ID NO: 2852 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctcgatccctcgctctttctcctacctcatctgggacatcatcatagcctcctgcttctactacgtcgccaccacttacttccctctcctccctcaccctctctcctacctcgtggcctctctactgggcctgccagggctgcgtcctaaccggcgtctgggtcatagcccacgagtgcggccaccacgcattcagcgactac

SEQ ID NO: 2853 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatccgggacatcatcatagcctcctgcttctactacgtcgccaccacttacttccctctcctccctcaccctctctcctacttgcctctctactgggcctgccagggctgcgtcctaaccggcgtctgggtcatagcccacgagtgcggccaccacgccttcagcgactac

SEQ ID NO: 2854 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgctggcccctctactgggcctgccaaggctgcgtcctaaccggcgtctgggtcatagcccacgagtgcggccaccacgccttcagcgactac

SEQ ID NO: 2855 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttggcctctctactgggcctgccagggctgcgtcctaaccggcgtctgggtcatagcccacgagtgcggccaccacgccttcagcgactac

SEQ ID NO: 2856 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccgtcttctgggtcatagcccacgagtgcggccaccacgccttcatcgactac

SEQ ID NO: 2857 - DNA, 339 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctactgggcctgccaagggtgcgtcctaaccggcgtctgggtcatagcccacgagtgcggccaccatgccttcagcgactac

SEQ ID NO: 2858 - DNA, 342 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccagggctgcgtcctaaccggcgtctgggtcatagcccacgagtgcggccaccacgccttcagcgactac

SEQ ID NO: 2859 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgcctgggctgcgtcctaaccggcgtctgggtcatagcccacgagtgcggccaccacgccttcagcgactac

SEQ ID NO: 2860 - DNA, 358 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctaacatggcctctctactgggcctgccaagggtgcgtcctaaccggcgtctgggtcatagcccacgagtgcggccaccacgccttcagcgactac

SEQ ID NO: 2861 - DNA, 332 bp, Artificial
  Mutation in BnaA.FAD2.a introduced by TALE nuclease pair BnFAD2_T01
caggatccatgggtgcaggtggaagaatgcaagtgtaacctccctccaaaaagactgaaaacgacaacatcaagcgagtaccctgcgagacaccgcccttaactgtcgaagaactcaagaaagcaatcccaccgcactgtttcaaacgctcgatccctcgctctttctcctacctcatctgggacatcatcatagcctcctgcttctactacgtcgccaccacttacttccctctcctccctcagcctctctactgggcctgccaagggtgcgtcctaaccggcgtcggggtcatagcccacgagtgctgccaccacgccctcagcgactac

SEQ ID NO: 2862 - DNA, 347 bp, Artificial
  Mutation in BnaA.FAD2.a introduced by TALE nuclease pair BnFAD2_T01
caggatccatgggtgcaggtggaagaatgcaagtgtctcctccctcccaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctacggggcctgccaaggctgcgtcctaacgggcgtctgggtcatagcccacaagtgcggccaccacgccttcagcgactac

SEQ ID NO: 2863 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccccttcggctctctactgggcctgccaagggtgcgtcctaaccggcgtctgggtcatagcccacgagtgcggccaccacgccttcagcgactac

SEQ ID NO: 2864 - DNA, 311 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccacctcactgcttcaaacgctccatcccacgctccttctcctcttcgacatcatcatctcctcctcggctcctccctcaccctctctcctactcgcctctctactgggcctgccagggctgcgtcctaaccggcgtctgggtcatagcccacgagtgcggccaccacgccgtcagcgactac

SEQ ID NO: 2865 - DNA, 342 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccatcaccctctctctgtctctctactgggcctgccaagggtgcgtcctaacgggcctctgggtcatagcccacgagtgcggccaccacgccttcagcgactac

SEQ ID NO: 2866 - DNA, 434 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcggctgttgccggtgctgtgccaggcccacggcttgaccccccagcaggtggtggccatcgccagcaagggcggtggcaagcaggcgctggaggcctggcctctctactgggcctgccaaggctgcgtcctaacgggcctctgggtcatcgcccacgaatgcggccaccacgccttcagcgactac

SEQ ID NO: 2867 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctaacgggcctctgggtcatcgcccacgaatgcggccaccacgccttcagcgacctac

SEQ ID NO: 2868 - DNA, 341 bp, Artificial
  Mutation in BnaA.FAD2.a introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacctctactgggcctgccagggctgcgtcctaaccggcgtctgggtcatagcccacgagtgcggccaccacgccttcagcgactac

SEQ ID NO: 2869 - DNA, 356 bp, Artificial
  Mutation in BnaA.FAD2.a introduced by TALE nuclease pair BnFAD2_T01
caggatccatgggtgcaggtggaagaatgcaagtgtatcctccctccaaaaagtctgaaaccgacaacctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgccgcctggcctctctactgggcctgccaagggtgcgtcctaaccggcgtctgggtcatagcccacgagtgcggccaccacgccttcagcgactac

SEQ ID NO: 2870 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacgtctctactgggcctgccagggctgcgtcctaaccggcgtctgggtcatagcccacgagtgcggccaccacgccttcagcgactac

SEQ ID NO: 2871 - DNA, 352 bp, Artificial
  Mutation in BnaA.FAD2.a introduced by TALE nuclease pair BnFAD2_T01
taggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctaccacctctccacagcctacttccctctcctcccccacccgctcccttaccgccctggcccctctactgggccggccaaggctgcgtcctaacgggcctctgggtcatagcccgcgagtgcggccaccacgccatcagcgactac

SEQ ID NO: 2872 - DNA, 332 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctctactgggcctgccaagggtgcgtcctaaccggcgtctgggtcatagcccacgagtgcggccaccacgccttcagcgactac

SEQ ID NO: 2873 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcctctctactgggcctgccaagggtgcgtcctaaccggcgtctgggtcatagcccacgagtgcggccaccacgccttcagcgactac

SEQ ID NO: 2874 - DNA, 350 bp, Artificial
  Mutation in BnaA.FAD2.a introduced by TALE nuclease pair BnFAD2_T01
caggatccatgggtgcaggtggaagaatgcaagtctctcctccctcccgctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcttctaggtgatagcccacgagtgcggccacctcgccgtcagcgactac

SEQ ID NO: 2875 - DNA, 351 bp, Artificial
  Mutation in BnaA.FAD2.a introduced by TALE nuclease pair BnFAD2_T01
caggatccatgggtgcaggtggaagaatgtaagtctctcctccctccagctcccacgaaaccaaaaccctcaaacgcgtcccctgcgagacaccacccttcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccagggctgcgtcctaaccggcgtctgggtcatagcccacgagtgcggccaccacgccttcagcgactac

SEQ ID NO: 2876 - DNA, 348 bp, Artificial
  Mutation in BnaA.FAD2.a introduced by TALE nuclease pair BnFAD2_T01
caggatccatgggtgcaggtggaagaatgcaagtctctcctccctccagctccccggaacccaaaccctcaaacgcgtcccctgcgagacaccacccttcactctcggagacctcaagaaagcaatcccacctcactgcttcaaacgccccatccctcgctctttctcctacctcatctgggacatcatcatagcctcctgcttctactacgtcgccaccacttacttccctctcctccctcaccctctctcctacttctgcctctctactgggcctgccagggctgcgtcctaaccggcgtctgggtcatagcccacgagtgcggccaccacgccttcagcgactac

SEQ ID NO: 2877 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacccccctggcctctctactgggcctgccagggctgcgtcctaaccggcgtctgggtcatagcccacgagtgcggccaccacgccttcagcgactac

SEQ ID NO: 2878 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccagggctgcgtcctaaccggcgtctgggtcatagcccacgagtgcggccaccacgccttcagcgactac

SEQ ID NO: 2879 - DNA, 352 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgcccccacttacttccctctcctccctcaccctctctcctaccgccctggcctctctactgggcctgccagggctgcgtcctaaccggcgtcggggtcatagcccacgagtgcggccaccacgcctttagcgactac

SEQ ID NO: 2880 - DNA, 408 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacttcgagccgaagtttccaaaaggtcgttgatcaaagctcgccgcgttgtttcatcaagccttggcctctctactgggcctgccaagggtgcgtcctaaccggcgtctgggtcatagcccacgagtgcggccaccacgccgtcagcgactac

SEQ ID NO: 2881 - DNA, 343 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctcccctgcctctctactgggcctgccagggctgcgtcctaaccggcgtctgggtcatagcccacgagtgcggccaccacgccttcagcgactac

SEQ ID NO: 2882 - DNA, 335 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccagggctgcgtcctaacgggcctctgggtcatcgcccacgaatgcggccaccacgccttcagcgactac

SEQ ID NO: 2883 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaaggctgcgtcctaaccggcgtctgggtcatagcccacgagtgcggccaccacgccttcagcgactac

SEQ ID NO: 2884 - DNA, 354 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttccgcctggcctctctactgggcctgccaagggtgcgtcctaaccggcgtctgggtcatagcccacgagtgcggccaccacgccttcagcgactac

SEQ ID NO: 2885 - DNA, 336 bp, Artificial
  Mutation in BnaA.FAD2.a introduced by TALE nuclease pair BnFAD2_T01
caggatccatgggtgcaggtggaagaatgcaagtctctcctccctccagctccaccggaaccaacaccctcaaacgcgtcccctgcgagacaccaccattcactctcggagacctcaagaaagcaatcccacctcactgcttcaaacgctccatcccacgctccttctcctcttcgacatcatcatagcctcctgcttctactacgtcgccaccacttacttccctctcctccctcaccctctctcctgcctctctactgggcctgccagggctgcgtcctaaccggcgtctgggtcatagcccacgagtgctgccaccacgccttcagcgactac

SEQ ID NO: 2886 - DNA, 345 bp, Artificial
  Mutation in BnaA.FAD2.a introduced by TALE nuclease pair BnFAD2_T01
caggatccatgggtgcaggtggaagaatgcaagtgtctcatccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccagggctgcgtcctaaccggcgtctgggtcatagcccacgagtgcggccaccacgccttcagcgactac

SEQ ID NO: 2887 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccaagggtgcgtcctaacgggcctctgggtcatagcccacgagtgcggccaccacgccttcagcgactac

SEQ ID NO: 2888 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccagggctgcgtcctaaccggcgtctgggtcatagcccacgagtgcggccaccacgccttcagcgactac

SEQ ID NO: 2889 - DNA, 277 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacgccttcagcgactac

SEQ ID NO: 2890 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgcaaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 2891 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacttggcctctctactgggcctgccagggctgcgtcctaaccggcgtctgggtcatagcccacgagtgcggccaccacgccttcagcgactac

SEQ ID NO: 2892 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaacccgacaacatcaagcgcgtaccctgcgagacaccgcccttcactgtcggagaactcaagaaagcaatcccaccgcactgtttcaaacgctcgatccctcgctctttctcctacctcatctgggacatcaccatagcctcctgcttctactacgtcgccaccacttacttccctctcctccctcaccctctcccctgcctctctactgggcctgccagggctgcgtcctaacgggcctctgggtcatagcccacgagtgcggccaccacgccttcagcgactac

SEQ ID NO: 2893 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccagggctgcgtcctaaccggcgtcggggtcatagcccacgagtgcggccaccacgccttcagcgactac

SEQ ID NO: 2894 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcttggcctctctactgggcctgccaagggtgcgtcctaaccggcgtctgggtcatagcccacgagtgcggccaccacgccttcagcgactac

SEQ ID NO: 2895 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctatacggcgtctgggtcatagcgcacgagtgcggcgaccgcgccttcagcgactac

SEQ ID NO: 2896 - DNA, 342 bp, Artificial
  Mutation in BnaA.FAD2.a introduced by TALE nuclease pair BnFAD2_T01
caggatccatgggtgcaggtggaagaatgcaagtgtctcctccttccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcgcctggcctctctactgggcctgccaagggtgcgtcctaaccggcgtctgggtcatagcccacgagtgcggccacctcgccttcagcgactac

SEQ ID NO: 2897 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcgcctggcctctctactgggcctgccaagggtgcgtcctaaccggcgtctgggtcatagcccacgagtgcggccaccacgccttcagcgactac

SEQ ID NO: 2898 - DNA, 347 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccagggctgcgtcctaaccggcgtctgggtcatagcccacgagtgcggccaccacgccttcagcgactac

SEQ ID NO: 2899 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacaggcctctctactgggcctgccagggctgcgtcctaaccggcgtctgggtcatagcccacgagtgcggccaccacgccttcagcgactac

SEQ ID NO: 2900 - DNA, 347 bp, Artificial
  Mutation in BnaA.FAD2.a introduced by TALE nuclease pair BnFAD2_T01
caggatccatgggtgcaggtggaagaatgcaaatgtctcctccctccaaaaagtctgaaaccgacaacatccagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcgcctctctactgggcctgccagggcttcgtcttaaccggcgtctgggtcatagcccactagtggtgccaccacgccttcagcgactac

SEQ ID NO: 2901 - DNA, 349 bp, Artificial
  Mutation in BnaA.FAD2.a introduced by TALE nuclease pair BnFAD2_T01
caggatccatgggtgcaggtggaagaatgcaagtgtatcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttaccttggcccctctactgggcctgccaaggctgcgtcctaacgggcctctgggtcatagcccacgagtgcggccaccacgccttcagcgactac

SEQ ID NO: 2902 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctctactgggcctgccaagggtgcgtcctaaccggcgtctgggtcatagcccacgagtgcggccaccacgccttcagcgactac

SEQ ID NO: 2903 - DNA, 340 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccaagggtgcgtcctaaccggcgtctgggtcatagcccacgagtgcggccaccacgccttcagcgactac

SEQ ID NO: 2904 - DNA, 355 bp, Artificial
  Mutation in BnaA.FAD2.a introduced by TALE nuclease pair BnFAD2_T01
caggatccatgggtgcaggtggaagaatgcaagtgtatcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctttggcctctctactgggcctgccaagggtgcgtcctaaccggcgtcggggtcatagcccacgagtgcggccaccacgccttcagcgactac

SEQ ID NO: 2905 - DNA, 352 bp, Artificial
  Mutation in BnaA.FAD2.a introduced by TALE nuclease pair BnFAD2_T01
caggatccatgggtgcaggtggaagaatgcaagtgtctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgctggcctctctactgggcctgccagggctgcgtcctaaccggcgtctgggtcatagcccacgagtgcggccaccacgccttcagcgactac

SEQ ID NO: 2906 - DNA, 349 bp, Artificial
  Mutation in BnaA.FAD2.a introduced by TALE nuclease pair BnFAD2_T01
caggatcatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 2907 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcacccatcctctctactgggcctgccagagctgcgtcctaaccggcgtcggggtcatagcccgcgagtgcggccaccacgccttcagcgactac

SEQ ID NO: 2908 - DNA, 354 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccatctcccctacctccgcctggcctctctactgggcctgccaaggctgcgtcctaacgggcctctgggtcatcgcccacgaatgcggccaccacgccttcagcgactac

SEQ ID NO: 2909 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgtcaagggtgcgtcctaaccggcgtctgggtcatagcccacgagtgcggccaccacgccttcagcgactac

SEQ ID NO: 2910 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctggcacatcatcatagcctcctgcttctactacgtcgccaccacttacttccctctcctccctcaccctcctctctactgggcctgccagggctgcgtcctaacgggcctctgggtcatcgcccacgaatgcggccaccacgccttcagcgactac

SEQ ID NO: 2911 - DNA, 350 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttttggcctctctactgggcctgccaagggtgcgtcctaaccggcgtctgggtcatagcccacgattgcggccaccacgccttcagcgactac

SEQ ID NO: 2912 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccaagggtgcgtcctaaccggcgtctgggtcatagcccacgagtgcggccaccacgccttcagcgactac

SEQ ID NO: 2913 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcctctgggtcatagcccacgagtgcggccaccacgccttcagcgactac

SEQ ID NO: 2914 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacctctctactgggcctgccagggctgcgtcctaaccggcgtctgggtcatagcccacgagtgcggccaccacgccttcagcgactac

SEQ ID NO: 2915 - DNA, 331 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccggcctgccagggctgcgtcctaaccggcgtctgggtcatagcccaccagtgcggccaccacgccttcagcgactac

SEQ ID NO: 2916 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccagggctgcgtcctaaccggcgtctgggtcatagcccacgagtgcggccaccacgccttcagcgactac

SEQ ID NO: 2917 - DNA, 344 bp, Artificial
  Mutation in BnaA.FAD2.a introduced by TALE nuclease pair BnFAD2_T01
caggatccatgggtgcaggtggaagaatgcaagtgtctccccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccctggcctctctactgggcctgccaagggtgcgtcctaaccggcgtctgggtcatagcccacgagtgcggccaccacgccttcagcgactac

SEQ ID NO: 2918 - DNA, 349 bp, Artificial
  Mutation in BnaA.FAD2.a introduced by TALE nuclease pair BnFAD2_T01
caggatccatgggtgcaggtggaagaatgcaagtgtatcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtcggggtcatagcccacgagtgcggccaccacgccttcagcgactac

SEQ ID NO: 2919 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccaagggtgcgtcctaaccggcgtctgggtcatagcccacgagtgcggccaccacgccttcagcgactac

SEQ ID NO: 2920 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcgcctgtcctctctactgggcctgccagggctgcgtcctaaccggcgtctgggtcatagcccacgagtgcggccaccacgccttcagcgactac

SEQ ID NO: 2921 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 2922 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccagggctgcgtcctaacgggcctctgggtcatagcccacgagtgcggccaccacgccttcagcgactac

SEQ ID NO: 2923 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaggaaagcaatcccaccgcactgtttcaaacgctcgatccctcgctctttctcctacctcatctgggacatcatcatagcctcctgcttctactacgtcgccaccacttacttccctctcctccctcaccctcctctctactgggcctgccagggctgcgtcctaaccggcgtctgggtcatagcccacgagtgcggccaccacgccttcagcgactac

SEQ ID NO: 2924 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctctctactgggcctgccaagggtgcgtcctaaccggcgtctgggtcatagcccacgaatgcggccaccacgccttcagcgactac

SEQ ID NO: 2925 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagcctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctgccctctactgggcctgccaaggctgcgtcctaacgggcctctgggtcatcgcccacgaatgcggccaccacgccttcagcgactac

SEQ ID NO: 2926 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacatggcctctctactgggcctgccaagggtgcgtcctaaccggcgtctgggtcatagcccacgagtgcggccaccacgccttcagcgactac

SEQ ID NO: 2927 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaacgggcctctgggtcatcgcccacgaatgcggccaccacgccttcagcgactac

SEQ ID NO: 2928 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccaagggtgcgtcctaaccggcgtctgggtcatagcccacgagtgcggccaccacgccttcagcgactac

SEQ ID NO: 2929 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctccctctaccacctctccacagcctacttccctctcctcccccaccctctcccttacctcgcgcctggcccctctactgggcctgccaaggctgcgtcctaacgggcctcttggtcatcgcccacgaatgcggccaccacgccttcagcgactac

SEQ ID NO: 2930 - DNA, 337 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctctactgggcctgccaagggtgcgtcctaaccggcgtctgggtcatagcccacgagtgcggccaccacgccttcagcgactac

SEQ ID NO: 2931 - DNA, 335 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccagggctgcgtcctaaccggcgtctgggtcatagcccacgaatgcggccaccacgccttcagcgactac

SEQ ID NO: 2932 - DNA, 357 bp, Artificial
  Mutation in BnaA.FAD2.a introduced by TALE nuclease pair BnFAD2_T01
caggatccatgggtgcaggtggaagaatgcaagtgtatcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccggtttgcgtattgccggcgcctggcctctctactgggcctgccaagggtgcgtcctaaccggcgtcggggtcatagcccacgagtgcggccaccacgccttcagcgactac

SEQ ID NO: 2933 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcatcctgcttctactacgtcgccaccacttacttccctctcctccctcaccctctctcccggcctctctactgggcctgccaaggctgcgtcctaacgggcctctgggtcatagcccacgagtgcggccaccacgccttcagcgactac

SEQ ID NO: 2934 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccagggctgcgtcctaaccggcgtctgggtcatagcccacgagtgcggccaccacggcttcagcgactac

SEQ ID NO: 2935 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtcggggtcatagcccacgagtgcggccaccacgccttcagcgactac

SEQ ID NO: 2936 - DNA, 349 bp, Artificial
  Mutation in BnaA.FAD2.a introduced by TALE nuclease pair BnFAD2_T01
caggatccatgggtgcaggcggaagaatgcaagtgtcccctccaaccaagaagactgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcggcctctctactgggcctgccagggctgcgtcctaaccggcgtcttggtgatagcccacaagtgcggccaccacgccatcaacgactac

SEQ ID NO: 2937 - DNA, 348 bp, Artificial
  Mutation in BnaA.FAD2.a introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 2938 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatccagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccagggctgcgtcctaaccggcgtctgggtcatagcccacgagtgcggccaccacgccttcagcgactac

SEQ ID NO: 2939 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgaggcctctctactgggcctgccagggctgcgtcctaaccggcgtctgggtcatagcccacgagtgcggccaccacgccttcagcgactac

SEQ ID NO: 2940 - DNA, 387 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccccggagcaggtggtggccatcgccagccacgatggcgcctggcctctctactgggcctgccagggctgcgtcctaacgggcctctgggtcatagcccacgagtgcggccaccacgccttcagcgactac

SEQ ID NO: 2941 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctacggggcctgccagggctgcgtcctaacgggcctctgggtcatagcccacgagtgcggccaccacgccttcagcgactac

SEQ ID NO: 2942 - DNA, 346 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggccggccagggctgcgtcctaaccggcgtctgggtcatagcccacgagtgcggccaccgcgccttcagcgactac

SEQ ID NO: 2943 - DNA, 351 bp, Artificial
  Mutation in BnaA.FAD2.a introduced by TALE nuclease pair BnFAD2_T01
caggatccatgggtgcaggtggaagaatgcaagtgactcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccaagggtgcgtcctaaccggcgtctgggtcatagcccacgagtgcggccaccacgccgtcagcgactac

SEQ ID NO: 2944 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaaatctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctccaccctcaccctctctcctacgcctggcctctctactgggcctgccagggctgcgtcctaaccggcgtctgggtcatatcccacgagtgcggccaccacgccttcagcgactac

SEQ ID NO: 2945 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccagggctgcgtcctaaccggcgtctgggtcatagcccacgagttcggccaccacgccttcagcgactac

SEQ ID NO: 2946 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcgctgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgggcctctctactgggcctgccaagggtgcgtcctaaccggcgtctgggtcatagcccacgagtgcggccaccacgccttcagcgactac

SEQ ID NO: 2947 - DNA, 332 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccagggctgcgtcctaaccggcgtctgggtcatagcccacgagtgcggccaccacgccttcagcgactac

SEQ ID NO: 2948 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaaggctgcgtcctaacgggcctctgggtcatagcccacgagtgcggccaccacgccttcatcgactac

SEQ ID NO: 2949 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctgctgggcctgccagggctgcgtcctaaccggcgtctgggtcatagcccacgagtgcggccaccacgccttcagcgactac

SEQ ID NO: 2950 - DNA, 325 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggctgcgtcctaaccggcgtctgggtcatatcccacgagtgctgccaccacgccttcagcgactac

SEQ ID NO: 2951 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctggcctctctactgggcctgccaagggtgcgtcctaaccggcgtctgggtcatagcccacgagtgcggccaccacgccttcagcgactac

SEQ ID NO: 2952 - DNA, 340 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccagggctgcgtcctaacgggcctctgggtcatagcccacgagtgcggccaccacgccttcagcgactac

SEQ ID NO: 2953 - DNA, 340 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctggggcatcatcatagcctcctgcttctactacgtcgccaccacgtacttccctctcctccctcaccctctctcctactctactgagcctgccaagggtgcgtcctaaccggcgtctgggtcatagcccacgagtgcggccaccacgccatcagcgactac

SEQ ID NO: 2954 - DNA, 344 bp, Artificial
  Mutation in BnaA.FAD2.a introduced by TALE nuclease pair BnFAD2_T01
caggatccatgggtacaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccagggctgcgtcctaaccggcgtcttggtcatagcccacgagtgcggccaccacgccttcagcgactac

SEQ ID NO: 2955 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggccggccagggctgcgtcctaaccggcgtctgggtcatagccctcgagtgcggccaccacgccttcagcgactac

SEQ ID NO: 2956 - DNA, 414 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccacaccctctctcctacttccccgacaaaatcgcgccgaaggatgtcgctgccgactgggcaatggagcgcctgccggcccacctggcctctctactgggcctgccaagggtgcgtcctaaccggcgtctgggtcatagcccacgagtgcggccaccacgccttcagcgactac

SEQ ID NO: 2957 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctggcacatcatcatagcctcctgcttctactacgtcgccaccacttacttccctctcctcccccaccctctctcctactcctggcctctctactgggcctgccagggctgcgtcctaaccggcgtctgggtcatagcccacgagtgcggccaccacgccttcagcgactac

SEQ ID NO: 2958 - DNA, 348 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacacactcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 2959 - DNA, 323 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatctcctcctcggctcctccctcaccctctctcctgcttcgctggcctctctactgggcctgccagggctgcgtcctaaccggcgtctgggtcatatcccacgagtgcggccaccacgccttcagcgactac

SEQ ID NO: 2960 - DNA, 339 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctactgggcctgccagggctgcgtcctaacgggcctctgggtcatagcccacgagtgcggccaccacgccttcagcgactac

SEQ ID NO: 2961 - DNA, 378 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctccagcgcctgcttgccgccatcgtggctggcgatggccaccacctgcgccggggtcaagtcgtgagggctgggtcatagcccacgagtgcggccaccacgccttcagcgactac

SEQ ID NO: 2962 - DNA, 335 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccagggctgcgtcctaaccggcgtctgggtcatagcccacgagtgcggccaccacgccttcagcgactac

SEQ ID NO: 2963 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagtgctgccaccacgccttcagcgactac

SEQ ID NO: 2964 - DNA, 348 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 2965 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaatggcctctctactgggcctgccagggctgcgtcctaaccggcgtctgggtcatagcccacgagtgcggccaccacgccttcagcgactac

SEQ ID NO: 2966 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcttggcctctctactgggcctgccagggctgcgtcctaaccggcgtctgggtcatagcccacgagtgcggccaccacgccttcagcgactac

SEQ ID NO: 2967 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacgtcatcatagcctcctgcttctactacgtcgccaccactcacttccctctcctccctcaccctctctccgcctacgcctctctactgagcctgccaagcgtgcgtcctaaccggcgtctaggtcatcgcccacgagtgctgccaccacgccatcatcgactac

SEQ ID NO: 2968 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctttggcctctctactgggcctgccagggctgcgtcctaacgggcctctgtgtcatcgcccacgaatgcggccaccacgccttcagcgactac

SEQ ID NO: 2969 - DNA, 354 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggtggcctctctactgggcctgccaagggtgcgtcctaaccggcgtctgggtcatagcccacgagtgcggccaccacgccttcagcgactac

SEQ ID NO: 2970 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaatggcctctctactgggcctgccagggctgcgtcctaaccggcgtctgggtcatagcccacgagtgcggccaccacgccttcagcgactac

SEQ ID NO: 2971 - DNA, 342 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgggcctgccagggctgcgtcctaaccggcgtctgtgtcatagcccacgagtgcggccaccacgccttcagcgacctac

SEQ ID NO: 2972 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctgcctctctactgggcctgccagggctgcgtcctaaccggcgtctgggtcatagcccacgagtgcggccaccacgccttcagcgactac

SEQ ID NO: 2973 - DNA, 313 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccatgcgagacaccgcccttcactgtcggagacctcaagaaagcaatccaacctcactgcttcaaacgctccatcccacgctccttctcctcttcgacatcatcatctcctcctcggctcctccctcaccatctctcctactttggcctctctactgggcctgccaagggtgcgtcctaaccggcgtctgggtcatagcccacgagtgcggccaccacgccttcagcgactac

SEQ ID NO: 2974 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctctctactgggcctgccagggctgcgtcctaaccggcgtctgggtcatagcccacgagtgcggccaccacgccttcagcgactac

SEQ ID NO: 2975 - DNA, 348 bp, Artificial
  Mutation in BnaA.FAD2.a introduced by TALE nuclease pair BnFAD2_T01
caggatccatgggtgcaggtggaagaatgcaagtgtatcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaaccggcgtctgggtcatagcccacgagtgcggccaccacgccttcagcgactac

SEQ ID NO: 2976 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgctggcctctctactgggcctgccagggctgcgtcctaaccggcgtctgggtcatagcccacgagtgcggccaccacgccttcagcaactac

SEQ ID NO: 2977 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctccatccctcgctctttctcctacctcatctgggacatcatcatagcctcctgcttctactacgtctccaccacttacttccctctcctccctcaccctctctcctccctcggcctctctactgggcctgccaaggctgcgtcctaaccggcgtctgggtcatagcccacgagtgcggccaccacgccttcagcgactac

SEQ ID NO: 2978 - DNA, 431 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtttgccggtgctgtgccaggcgctcggtcgttcggctgcggcgagcggtatcagctcactcaaaggcggtaatacggttatcctggcctctctactgggcctgccagggctgcgtcctaaccggcgtctgggtcatagcccacgagtgcggccaccacgccttcagcgactac

SEQ ID NO: 2979 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgacgccaccacttacttccctctcctccctcaccctctctcccactagcctctctactgcgcctgtcaagggtgcgtcctaaccggcgtctgggtcatagcccacgagtgcagccaccgcgccatcaacgactac

SEQ ID NO: 2980 - DNA, 342 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgcccctctactgggcctgccagggctgcgtcctaaccggcgtctgggtcatagcccacgagtgcggccaccacgccttcagcgactac

SEQ ID NO: 2981 - DNA, 357 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctccccccgcctggcctctctactgggcctgccagggctgcgtcctaaccggcgtctgggtcatagcccacgagtgcggccaccacgccttcagcgactac

SEQ ID NO: 2982 - DNA, 357 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcgcgcctggcctctctactgggcctgccagggctgcgtcctaaccggcgtctgggtcatagcccacgagtgcggccaccacgccttcagcgactac

SEQ ID NO: 2983 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccagggctgcgtcctaaccggcgtctgggtcatagcccacgagtgcggccaccacgccttcagcgactac

SEQ ID NO: 2984 - DNA, 398 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgccaacttctcaagattgcaaaacgtggcggcgtgaccgcagtggaggcagtgcatgcgcctctctactgggcctgccaagggtgcgtcctaacgggcctctgggtcatcgcccacgaatgcggccaccacgccttcagcgactac

SEQ ID NO: 2985 - DNA, 354 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgccttggcctctctactgggcctgccagggctgcgtcctaaccggcgtctgggtcatcgcccacgaatgcggccaccacgccatcagcgactac

SEQ ID NO: 2986 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactagcctctctactgggcctgccaagggtgcgtcctaaccggcgtctgggtcatagcccacgagtgcggccaccacgccatcagcgactac

SEQ ID NO: 2987 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacctcaagcgcgtaccctgcgagacaccgcccttcactgtcggagaactcaagaaagcaatcccaccgcactgtttcaaacgctccatccctcgctctttctcctacctcatctgggacatcatcatagcctcctgcttctactacgtcgccaccacttacttccctctcctccctcaccctctcccccacttggcctctctactgggcctgccagggctgcgtcctaaccggcgtctgggtcatagcccacgagtgcggccaccacgccttcagcgactac

SEQ ID NO: 2988 - DNA, 349 bp, Artificial
  Mutation in BnaA.FAD2.a introduced by TALE nuclease pair BnFAD2_T01
caggatccatgggtgcaggtggaagaatgcaagtgtatcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactatggcctctctactgggcctgccagggctgcgtcctaaccggcgtctgggtcatagcccacgagtgcggccaccacgccttcagcgactac

SEQ ID NO: 2989 - DNA, 423 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccccttacttccctctcctccctcaccctctctcctactgtgccaggcccgcggcttgaccccggagcagggggtggccatcgccagccacgatggcggcaacagccgctggactggcctctctactgggcctgccagggctgcgtcctaaccggcgtctgggtcatagcccacgagtgcggccaccacgccttcagcgactac

SEQ ID NO: 2990 - DNA, 344 bp, Artificial
  Mutation in BnaA.FAD2.a introduced by TALE nuclease pair BnFAD2_T01
caggatccatgggtgcaggtggaagaatgcaagtgactcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcccctctactgggcctgccaaggctgcgtcctaacgggcctctgggtcatcgcccacgaatgcggccaccacgccttcagcgactac

SEQ ID NO: 2991 - DNA, 401 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgccataaactgccaggcatcaaactaagcagaaggccatccgtccataggctggcctctctactgggcctgccaagggtgcgtcctaaccggcgtctgggtcatagcccacgagtgcggccaccacgccttcagcgactac

SEQ ID NO: 2992 - DNA, 329 bp, Artificial
  Mutation in BnaA.FAD2.a introduced by TALE nuclease pair BnFAD2_T01
caggatccatgggtgcaggtggaagaatgcaagtgaatcatacctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgggcctgccagtgctgcgtcctaaccgtcgtctgggtcatagccctcgagtgcggccaccacgccttcagcgactac

SEQ ID NO: 2993 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaaggctgcgtcctaacgggcctctgggtcatcgcccacgaatgcggccaccacgccttcagcgacgac

SEQ ID NO: 2994 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccaccattcactctcggagacctcaagaaagcaatcccacctcactgcttcaaacgctccatcccacgctccttctcctcttcgacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgattac

SEQ ID NO: 2995 - DNA, 349 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagctactac

SEQ ID NO: 2996 - DNA, 356 bp, Artificial
  Mutation in BnaA.FAD2.a introduced by TALE nuclease pair BnFAD2_T01
caggatccatgggtgcaggtggaagaatgcaagtgtcacctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccagggctgcttcctaaccggcgtcggggtcatatcccacgagtgcggccaccacgccatcagcgactac

SEQ ID NO: 2997 - DNA, 414 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagactccgcccttcactgtcggagaactcaagaaagcaatcccaccgcactgtttcaaacgctcgatccctcgctctttctcctacctcatctgggacatcatcatagcctcctgcttctactacgtcgccaccacttacttctctctcctccctccccctctgccgaactacaccggcaaaatcacgccgaagtatgtagctgcctgctgggcaacggcggcccggccggcccacctagcctctctactgggagtgccaagggtgcggcctaacaggcgtctgggtcatagcccacgagtgcggccaccacgccatcagcgactac

SEQ ID NO: 2998 - DNA, 339 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccggcctgccagggctgcgtcctaaccggcgtctgggtcatagcccacgagtgcggccaccacgccttcagcgactac

SEQ ID NO: 2999 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcccctggcctctctactgggcctgccagggctgcgtcctaaccggcttctgggtcatagcccacgagtgcggccaccacgccttcagcgactac

SEQ ID NO: 3000 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctggcctctctactgggcctgccaagggtgcgtcctaaccggcgtctgggtcatagcccacgagtgcggccaccacgccttcagcgactac

SEQ ID NO: 3001 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgcctccacttacttccctctcctccctcaccctctctcctcctcctggcctctctactgtgcctgccagggctgcgtcctaaccggcgtctgggtcatagcccacgagtgcggccaccacgccttcagcgactac

SEQ ID NO: 3002 - DNA, 350 bp, Artificial
  Mutation in BnaA.FAD2.a introduced by TALE nuclease pair BnFAD2_T01
caggatccatgggtgcaggtcgcagaatgcaagtctctcctccctccagctcccccggaaccaacaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 3003 - DNA, 338 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctaccaccgggcctgccaagggtgcgtcctaaccggcgtctgggtcattgcccacgagtgccgcccccacgccctccgcgactac

SEQ ID NO: 3004 - DNA, 346 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacggcctctctactgggcctgccagggctgcgtcctaaccggcgtctgggtcatagcccacgagtgcggccaccacgccttcagcaactac

SEQ ID NO: 3005 - DNA, 339 bp, Artificial
  Mutation in BnaA.FAD2.a introduced by TALE nuclease pair BnFAD2_T01
caggatccatgggtgcaggtggaagaatgcaagtgtctcctccctccaaaaagcctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacttactgggcctgccagggctgcgtcctaacgggcctctgggtcatagcccacgagtgcggccaccacgccttcagcgactac

SEQ ID NO: 3006 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgctggcctctctactgggcctgccagggctgcgtcctaacgggcctctgggtcatagcccacgagtgcggccaccacgccttcagcgactac

SEQ ID NO: 3007 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgcctttggcctctccactgggcctgccggggctgcgcccaaaccggcctgtgggtcatagcccgcgagcgcggccaccacgcccagcgactcc

SEQ ID NO: 3008 - DNA, 334 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccagggctgcgtcctaaccggcgtctgggtcatagcccacgagtgcggccaccacgccttcagcgactac

SEQ ID NO: 3009 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccgtcagcgactac

SEQ ID NO: 3010 - DNA, 349 bp, Artificial
  Mutation in BnaA.FAD2.a introduced by TALE nuclease pair BnFAD2_T01
caggatccatgggtgcaggtggaagaatgcaagtctcccctccctccagctcccccggaaccaacaccctcaaacgcgtcccctgcgagacaccaccattcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctgcctctctactgggcctgccagggctgcgtcctaaccggcgtctgggtcatagccctcgagtgcggccaccacgccttcagcgactac

SEQ ID NO: 3011 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcttcgcccctggcctctctactgggcctgccagggctgcgtcctaaccggcgtctgggtcatagcccacgagtgcggccaccacgccttcagcgactac

SEQ ID NO: 3012 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacagcatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccagggctgcgtcctaaccggcgtctgggtcatagcccacgagtgcggccaccacgccttcagcgactac

SEQ ID NO: 3013 - DNA, 347 bp, Artificial
  Mutation in BnaA.FAD2.a introduced by TALE nuclease pair BnFAD2_T01
caggatccatgggtgcaggtggaagaatgcaagtgtctcctccccccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaatggcctctctactgggcctgccagggctgcgtcctaaccggcgtctgggtcatagcccacgagtgcggccaccacgccttcagcgactac

SEQ ID NO: 3014 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacgccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatatcccacgagtgcggcctccacgccatcagcgactac

SEQ ID NO: 3015 - DNA, 417 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcataccctgcgagacaccgcccttcactgtcggagaactcaagaaagcaatcccaccgcactgtttcaaacgctcgatccctcgctctttctactacctcatctgggacatcatcatagcctcctgcttctactacgtcgccaccacttacttccctctcctccctcaccctctctcctacttcgtcaggacatgatcgcagcgttgccagagcgagattctccgcgctgtagaagtcaccattgttgtgctggcctctctactgggcctgccagggctgcgtcctaaccggcgtctgggtcatagcccacgagtgcggccaccacgccttcagcgactac

SEQ ID NO: 3016 - DNA, 340 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctccctccctctactgggcctgccaaggctgcgtcctaacgggcctctgggtcatagcccacgagtgcggccaccacgccttcagcgactac

SEQ ID NO: 3017 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacttctctactgggcctgccaagggtgcgtccgaacgggcctcggggttatcgcccacaaatgcggccaccacgccatcagcgactac

SEQ ID NO: 3018 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccaactaggcctctctactgggcctgccaagggtgcgtcctaaccggcgtctgggtcatagcccacgagtgcggccaccacgccttcaacgactac

SEQ ID NO: 3019 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcaccaaggccacactactgggcctgccagggctgcgtcctagccggggtcgaggtgaaagcccacgagtgcggccaggaggccttcagcaactac

SEQ ID NO: 3020 - DNA, 348 bp, Artificial
  Mutation in BnaA.FAD2.a introduced by TALE nuclease pair BnFAD2_T01
caggatctatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggcggcgtccgaaccggcgtcgagggcatagcccacgagtgcggccaccacgcctgcagcgactac

SEQ ID NO: 3021 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctctccctctctcctcctggcctctctactgggcctgccaagggtgcgtcctaaccggcgtctgggtcatagcccacgagtgcggccaccacgccttcagcgactac

SEQ ID NO: 3022 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagtccacgagtgcggccaccacgccttcagcgactac

SEQ ID NO: 3023 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgccttcagcgactac

SEQ ID NO: 3024 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctactacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 3025 - DNA, 345 bp, Artificial
  Mutation in BnaA.FAD2.a introduced by TALE nuclease pair BnFAD2_T01
caggatccatgggtgcaggtggcagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccagggctgcgtcctaaccggcgtctgggtcatagcccacgagtgcggccaccacgccttcagcgactac

SEQ ID NO: 3026 - DNA, 346 bp, Artificial
  Mutation in BnaA.FAD2.a introduced by TALE nuclease pair BnFAD2_T01
caggatccatgggtgcaggtggcagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgccgatggcctctctactgggcctgccaaggctgcgtcctaacgggcgtctggggcatagcccacgagtgcggccaccacgccttcagcgactac

SEQ ID NO: 3027 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccagggctgcgtcctaaccggcgtctgggtcatagcccacgagtgcggccaccacgccttcagcgactac

SEQ ID NO: 3028 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaaggctgcgtcctaacgggcctctgggtcatagcccacgagtgcggccaccacgccttcagcgactac

SEQ ID NO: 3029 - DNA, 415 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacttcgctggagacgatggccaccacctgctggggggtcaagttgagcggggcacccgtcagtgcatgcatggcctctctactgggcctgccagggctgcgtcctaaccggcgtctgggtcatagcccacgagtgcggccaccacgccttcagcgactac

SEQ ID NO: 3030 - DNA, 325 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccacctcttacttccctctcctccctcaccctctctccgccttggctgcgtcctaaccggcgtctgggtcatagcccacgagtgcggccaccacgccttcagcgactac

SEQ ID NO: 3031 - DNA, 387 bp, Artificial
  Mutation in BnaA.FAD2.a introduced by TALE nuclease pair BnFAD2_T01
caggatcaatgggtgcaggtgggagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgccatcgtggctggcgatgcccaccacctgctcctggcctctctactgggcctgccagggctgcgtcctaaccggcgtctgggtcatagcccacgagtgcggccaccacgccttcagcgactac

SEQ ID NO: 3032 - DNA, 340 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttactgggcctgccagggctgcgtcctaaccggcgtctgggtcatagcccacgagtgcggccaccacgccttcagcgactac

SEQ ID NO: 3033 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgctggcctctctactgggcctgccagggctgcgtcctaaccggcgtctgggtcatagcccacgagtgcggccaccacgccttcagcgactac

SEQ ID NO: 3034 - DNA, 350 bp, Artificial
  Mutation in BnaA.FAD2.a introduced by TALE nuclease pair BnFAD2_T01
caggatccatgagtgcaggtggaagaatgcaagtatatcctccctccaaaaagtctgaaactgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 3035 - DNA, 350 bp, Artificial
  Mutation in BnaA.FAD2.a introduced by TALE nuclease pair BnFAD2_T01
caggatccatgggtgcaggtcgaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 3036 - DNA, 350 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagctactac

SEQ ID NO: 3037 - DNA, 434 bp, Artificial
  Mutation in BnaA.FAD2.a introduced by TALE nuclease pair BnFAD2_T01
caggatccatgggtgcaggtggaagaatgcaagtctctcctccctccagctcccccgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcggctgttgccggtgctgtgccaggcccacggcttgaccccccagcaggtggtggccatcgccagcaatggcggtggcaagcaggcgctggaggcctggcctctctactgggcctgccagggctgcgtcctaaccggcgtctgggtcatagcccacgagtgcggccaccacgccttcagcgactac

SEQ ID NO: 3038 - DNA, 347 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcatcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccagggctgcgtcctaaccggcgtctgggtcatagcccacgagtgcggccaccacgccttcagcgactac

SEQ ID NO: 3039 - DNA, 339 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccctctactgggcctgccagggctgcgtcctaacctgcgtctgggtcatagcccacgagtgcggccaccacgccttcagcgactac

SEQ ID NO: 3040 - DNA, 344 bp, Artificial
  Mutation in BnaA.FAD2.a introduced by TALE nuclease pair BnFAD2_T01
caggatccattggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccagggctgcgtcctaaccggcgtctgggtcatagcccacgagtgcggccaccacgccttcagcgactac

SEQ ID NO: 3041 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccagggctgcgtcctaaccggcgtctgggtcatagcccacgagtgcggccaccacgccttcagcgacta

SEQ ID NO: 3042 - DNA, 347 bp, Artificial
  Mutation in BnaA.FAD2.a introduced by TALE nuclease pair BnFAD2_T01
caggatccatgggtgcaggtggaagaatgcaagtgtctcctcccccccaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagggcggccaccacgccatcagcgactac

SEQ ID NO: 3043 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccagggctgcgtcctaaccggcgtctgggtcatagcccacgagtgcggccaccacgccttcagcgtac

SEQ ID NO: 3044 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgtgtcctaaccggcgtctgggtcatagcccacgagtgcggccaccacgccttcagcgactac

SEQ ID NO: 3045 - DNA, 337 bp, Artificial
  Mutation in BnaA.FAD2.a introduced by TALE nuclease pair BnFAD2_T01
caggatccatgggtgcaggtggaagaatgcaagtgtctcctccctccagctcccccgaaaccaacaccctcaaacacgtcccctgcgagacaccaccattcactctcggagacctcaagaaagcaatcccacctcactgcttcaaacgctccatcccacgctccttctcctcttcgacatcatcatagcctcctgcttctactacgtcgccaccacttacttccctctcctccctcaccctctctcccggcctctctactcggcctgccaggactgcgtcctaaccggcgtctgggtcatagcccacgagtgcggccaccacgccttcagcgactac

SEQ ID NO: 3046 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactttcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccagggctgcgtcctaaccggcgtctgggtcatagcccacgagtgcggccaccacgccttcagcgactac

SEQ ID NO: 3047 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcctctgggtcatagcccacgagtgcggccaccacgccttcagcgactac

SEQ ID NO: 3048 - DNA, 347 bp, Artificial
  Mutation in BnaA.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccagggctgcgtcctaacgggcctctgggtcatcgcccacgaatgcggccaccacgccttcagcgactac

SEQ ID NO: 3049 - DNA, 338 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcatacctcatctgggacatcatcatagcctcctgcttctactacgtcgccaccacttacttccctctcctccctcaccctctctcctattactgggcctgccagggctgcgtcctaaccggcgtctgggtcatagcccacgagtgcggccaccacgccttcagcgactac

SEQ ID NO: 3050 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcaccaccacttacttccctctcctccctcaccctctctcctactttggcctctctactgggcctgccaaggctgcgtcctaacgggcctctgggtcatcgcccacgaatgcggccaccacgcctgcagcgactac

SEQ ID NO: 3051 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaatggcctctctactgggcctgccaagggtgcgtcctaacgggcgtctgggtcatagcccacgagtgcggccaccacgccttcagcgactac

SEQ ID NO: 3052 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcataaccggcgtctgggtcatagcccacgagtgcggccaccacgccttcagcgactac

SEQ ID NO: 3053 - DNA, 351 bp, Artificial
  Mutation in BnaA.FAD2.a introduced by TALE nuclease pair BnFAD2_T01
caggatccatgggtgcaggtggaagaatgcaagtctctcctccctccagctcccccggaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgtggcctctctactgggcctgccagggctgcgtcctaaccggcgtctgggtcatagcccacgagtgcggccaccacgccttcagcgactac

SEQ ID NO: 3054 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatccgggacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgccttcagcgactac

SEQ ID NO: 3055 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcacctgcctctctactgggccggccagggctgcgtcctaaccggcgtctgggtcatagcccacgagtgcggccaccacgccttcagcgactac

SEQ ID NO: 3056 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcctctctactgggcctgccagggctgcgtcctaaccggcgtctgggtcatagcccacgagtgcagccaccacgccttcagcgactac

SEQ ID NO: 3057 - DNA, 358 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgggtctggcctctctactaggcctgccagggctgcgtcctaaccggcgtctgggtcatagcccacgagtgcggccaccacgccttcagcgactac

SEQ ID NO: 3058 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctttggcctctctactgggcctgccagggctgcgtcctaaccggcgtctgggtcatagcccacgagtgcggccaccacgccttcagcgactac

SEQ ID NO: 3059 - DNA, 347 bp, Artificial
  Mutation in BnaA.FAD2.a introduced by TALE nuclease pair BnFAD2_T01
caggatccatgggtgcaggtggcagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctaccccatctgggacatcatcatagcctcctgcttctactacgtcgccaccacttacttccctctcctccctcaccctctctcctacttgcctctctactgggcctgccagggctgcgtcctaaccggcgtctgggtcatagcccacgagtgcggccaccacgccttcagcgactac

SEQ ID NO: 3060 - DNA, 277 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacgccttcagcgactac

SEQ ID NO: 3061 - DNA, 277 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcacgccttcagcgactac

SEQ ID NO: 3062 - DNA, 355 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccactccgcccctggcctctctactgggcctgccaaggctgcgtcctaacgggcctctgggtcatagcccacgagtgcggccaccacgccttcagcgactac

SEQ ID NO: 3063 - DNA, 335 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctcttcgacatcatcatctcctcctcggctcctccctctaccacctctccacagcctacttccctctcccttaccttggcccctctactgggcctgccaaggctgcgtcctaacgggcctctgggtcatcgcccacgaatgcggccaccacgccttcagcgactac

SEQ ID NO: 3064 - DNA, 341 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatctctactgggcctgccagggctgcgtcctaaccggcgtctgggtcatagcccacgagtgcggccaccacgccttcagcgactac

SEQ ID NO: 3065 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgcgacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttactgggcctgccagggctgcgtcctcaccggcgtctgggtcatagcccacgagggcggccaccacgccttcagcgactcc

SEQ ID NO: 3066 - DNA, 350 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 3067 - DNA, 351 bp, Artificial
  Mutation in BnaA.FAD2.a introduced by TALE nuclease pair BnFAD2_T01
caggatccatgggtgcaggtggaaaaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccagggctgcgtcctaaccggcgtctgggtcatagcccacgagtgcggccaccacgccttcagcgactac

SEQ ID NO: 3068 - DNA, 325 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccatgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggctgcgtcctaaccggcgtctgggtcatagcccacgagtgcggccaccacgccttcagcgactac

SEQ ID NO: 3069 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctcaactgggcctgccagggctgcgtcctaaccggcgtctgggtcatagcccacgagtgcggccaccacgccttcagcgactac

SEQ ID NO: 3070 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgcctgcagcgactac

SEQ ID NO: 3071 - DNA, 347 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatatcctcctgcttctactacgtcgccacctcttacttccctctcctccctcaccctctctccgcctggcctctctactgggcctgccagggctgcgtcctaacgggcctctgggtcatcgcccacgaatgcggccaccacgccttcagcgactac

SEQ ID NO: 3072 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacgcctctctactgggcctgccagggctgcgtcctaaccggcgtctgggtcatagcccacgagtgcggccaccacgccttcagcgactac

SEQ ID NO: 3073 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctacttggcctgccagggctgcgtcctaaccggcgtctgggtcatagcccacgagtgcggccaccacgccttcagcgactac

SEQ ID NO: 3074 - DNA, 330 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgcttcaaacgctccatcccacgctccttctcctcttcgacatcattatctcctcctcggctcctccctctaccacctctccacagcctacttccctctcctcccccaccctctctcctactgccaagggtgcgtcctaacgggcctctgggtcatcgcccacgaatgcggccaccacgccttcagcgactac

SEQ ID NO: 3075 - DNA, 378 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctccagcgcctgcttgtcgccatcgtggctggcgatggccaccacctgctccggggtcaagccgtgagggctgggtcatagcccacgagtgcggccaccacgccttcagcgactac

SEQ ID NO: 3076 - DNA, 347 bp, Artificial
  Mutation in BnaA.FAD2.a introduced by TALE nuclease pair BnFAD2_T01
caggatccatgggtgcaggtggaagaatgcaagtgtatcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccagggctgcgtcctaaccggcgtctgggtcatagcccacgagtgcggccaccacgccttcagcgactac

SEQ ID NO: 3077 - DNA, 341 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 3078 - DNA, 409 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggctagcggtacgcgtattaattgcgttgcgctcactgcccgctttccagtcgggaaactggcctctctactgggcctgccagggctgcgtcctaaccggcgtctgggtcatagcccacgagtgcggccaccacgccttcagcgactac

SEQ ID NO: 3079 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaatcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgctggcctctctactgggcctgccaagggtgcgtcctaaccggcctctgggtcatagcccacgagtgcggccaccacgccttcagcgactac

SEQ ID NO: 3080 - DNA, 347 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 3081 - DNA, 355 bp, Artificial
  Mutation in BnaA.FAD2.a introduced by TALE nuclease pair BnFAD2_T01
aaggatacatgggtgcaggtggcagaatgcaagtgtctaccctctcaaaaaagtctgaagccgacaacataaagcgcgtaccctgcgagacaccgcccttaactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccagggctgcgtcctaaccggcgtctgggtcatagcccacgagtgctgccaccacgccatcagcgactac

SEQ ID NO: 3082 - DNA, 331 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgggcctgccagggctgcgtcctaaccggcctctgggtcatagcccacgagtgcggccaccacgccttcagcgactac

SEQ ID NO: 3083 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccgcctggcctctctactgggcctgccagggctgcgtcctaaccggcgtctgggtcatagcccacgagtgcggccaccacgccttcagcgactac

SEQ ID NO: 3084 - DNA, 342 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccagggctgcgtcctaaccggcgtctgggtcatagcccacgagtgcggccaccacgccttcagcgactc

SEQ ID NO: 3085 - DNA, 341 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctactccctcaccctctctcctacttcgcctgggcctgccagggctgcgtcctaaccggcgtctgggtcatagcccacgagtgcggccaccacgccttcagcgactac

SEQ ID NO: 3086 - DNA, 348 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagtaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgtgcctgccagggctgcgtcctaaccggcgtctgggtcatagcccacgagtgcggccaccacgccttcagcgactac

SEQ ID NO: 3087 - DNA, 339 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctactgggcctgccagggctgcgtcctaaccggcgtctgggtcatagcccacgagtgcggccaccacgccttcagcgactac

SEQ ID NO: 3088 - DNA, 331 bp, Artificial
  Mutation in BnaA.FAD2.a introduced by TALE nuclease pair BnFAD2_T01
caggatccatggtgcaggtggacgaatgcaagtgtctcctccctcccaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcatagcccacgagggcggccaccacgccttcagcgactac

SEQ ID NO: 3089 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccagggctgcgtcctaaccggcgtctgggtcatagcccacgagtgcggccaccacgccttcagcgactac

SEQ ID NO: 3090 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctggggcatcaccatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 3091 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgcctctctactgggcctgccagggctgcgtcctaacgggcctctgggtcatagcccacgagtgcggccaccacgccttcagcgactac

SEQ ID NO: 3092 - DNA, 346 bp, Artificial
  Mutation in BnaA.FAD2.a introduced by TALE nuclease pair BnFAD2_T01
caggatccatgggtgcaggtggaagaatgcaagtgtctcccccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctgccctctactgggccggccaaggctgctgcctaacgggcctctgggtcatcgcccacgaatgctgccaccacgccttcagcgactac

SEQ ID NO: 3093 - DNA, 343 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccagggctgcgtcctaaccggcgtctgggtcatagcccacgagtgcggccaccacgccttcagcgactac

SEQ ID NO: 3094 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcataccctcctgcttctactacgtcgccaccacttacttccctctcctccctcaccccctctcctcccctggcctctctactgggcctgccagggctgcgtcctaaccggcgtctgggtcatagcccacgagtgcggccaccacgccttcagcgactac

SEQ ID NO: 3095 - DNA, 340 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttactgggcctgccagggctgcgtcctaaccggcgtctgggtcatagcccacgagtgcggccaccacgccttcaagcgactac

SEQ ID NO: 3096 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttatggcctctctacggggcctgccagggctgcgtcctaaccggcgtctggggcatagcccacgagtgcggccaccacgccatcagcgactac

SEQ ID NO: 3097 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcgtccaccacgccttcagcgactac

SEQ ID NO: 3098 - DNA, 347 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactcccggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctactggcctctctactgggcctgccagggctgcgtcctaaccggcgtctgggtcatagcccacgagtgcggccaccacgccttcagcgactac

SEQ ID NO: 3099 - DNA, 344 bp, Artificial
  Mutation in BnaA.FAD2.a introduced by TALE nuclease pair BnFAD2_T01
caggatccatgggtgcaggtggaagaatgcaagtgtctcatccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctcgcctctctactgggcctgccagggctgcgtcctaaccggcgtctgggtcatagcccacgagtgcggccaccacgccttcagcgactac

SEQ ID NO: 3100 - DNA, 349 bp, Artificial
  Mutation in BnaA.FAD2.a introduced by TALE nuclease pair BnFAD2_T01
caggatccatgggtgcaggcggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaaggctgcgtcctaacgggcctctgggtcatcgcccacgaatgcggccaccacgccatcagcgactac

SEQ ID NO: 3101 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcttggcctctctactgggcctgccaagggtgcgtcctaaccggcgtctgggtcatagcccacgagtgcggccaccacgccttcagcgactac

SEQ ID NO: 3102 - DNA, 334 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccagggctgcgtcctaaccggcgtctgggtcatagcccacgagtgcggccaccacgccttcagcgactac

SEQ ID NO: 3103 - DNA, 429 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgggcgtcctgcccgccaccctccgggccgttgcttcacgccatcgtggctggcgatggccaccacctgctccggggtcatggcctctctactgggccagccagggctgcgtcctaacgggcgtctgggtcatagcccacgagtgcggccaccacgccttcagcgactac

SEQ ID NO: 3104 - DNA, 332 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccagggctgcgtcctaaccggcgtctgggtcatagcccacgagtgcggccaccacgccttcagcgactac

SEQ ID NO: 3105 - DNA, 339 bp, Artificial
  Mutation in BnaA.FAD2.a introduced by TALE nuclease pair BnFAD2_T01
caggatccatgggcgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccggcctgccagggctgcgtcctaaccggcgtctgggtcatagcccacgagtgcggccaccacgccttcagcgactac

SEQ ID NO: 3106 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcggcctctctactgggcctgccaagggtgcgtcctaaccggcgtctgggtcatagcccacgagtgcggccaccacgccttcaacgactac

SEQ ID NO: 3107 - DNA, 335 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctactgggcctgccagggctgcgtcctaaccggcgtctgggtcatagcccacgagtgcggccaccacgccttcagcgactac

SEQ ID NO: 3108 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctatactgggcctgccagggctgcgtcctaaccggcgtctgggtcatagcccacgagtgcggccaccacgccttcagcgactac

SEQ ID NO: 3109 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccagggctgcgtcctaaccggcgtctgggtcatagcccacgagtgcggccaccacgccttcagcgactac

SEQ ID NO: 3110 - DNA, 342 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccagggctgcgtcctaaccggcgtctgggtcatagcccacgagtgcggccaccacgccttcagcgactac

SEQ ID NO: 3111 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctatcctctctactgggcctgccagggctgcgtcctaaccggcgtctgggtcatagcccacgagtgcggccaccacgccttcagcgactac

SEQ ID NO: 3112 - DNA, 348 bp, Artificial
  Mutation in BnaA.FAD2.a introduced by TALE nuclease pair BnFAD2_T01
caggacccatgggtgcaggtggaagaatgcaagtgtctcctccctccaaaaagtctgaaatcgacaacatcaagcgcgtaccctgcgagacaccgcccttcactgtcggagaactcaagaaagcaatcccaccgcactgttgcaaacgctccatcccacgctccttctcctcttcgacatcatcatctcctcctcggctcctcccgctaccacctctccacagcctccttccctctcctccctcaccctctccccgactcgcctctctactgggcctgccagggctgcgtcctaaccggcgtctgggtcatagcccacgagtgcggccaccacgccatcagcgactac

SEQ ID NO: 3113 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccagggctgcgtcctaacgggcctctgggtcatcgcccacgaatgcggccaccacgccttcagcgactac

SEQ ID NO: 3114 - DNA, 332 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccagggctgcgtcctaacgggcctctgggtcatagcccacgagtgcggccaccacgccttcagcgactac

SEQ ID NO: 3115 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 3116 - DNA, 393 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgatacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctaacggtgcaggcgctgttgccggtgctgtgccaggcccacggcttgacccctggcctctctactgggcctgccaagggtgcgtcctaaccggcctctgggtcatagcccacgagtgcggccaccacgccttcagcgactac

SEQ ID NO: 3117 - DNA, 380 bp, Artificial
  Mutation in BnaA.FAD2.a introduced by TALE nuclease pair BnFAD2_T01
caggatccatgggtgcaggtggaagaatgcaagtgtattctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcccagtggtccgccgcacgcgctctggaggcctgcctctctactgggcctgccaagggtgcgtcctaactggcctctgggtcatcgcccacgaatgcggccaccgcgccatcagcgactac

SEQ ID NO: 3118 - DNA, 338 bp, Artificial
  Mutation in BnaA.FAD2.a introduced by TALE nuclease pair BnFAD2_T01
caggatccatgggtgcaggtggcagaatgcaagtctctcctccctccagctcccccggaaccaacaccctcaaacgcgtcccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattactgggcctgccagggctgcgtcctaaccggcgtctgggtcatagcccacgagtgcggccaccacgccttcagcgactac

SEQ ID NO: 3119 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttacctctctactgggcctgccaagggtgcgtcctaaccggcgtctgggtcatagcccacgagtgcggccaccacgccttcagcgactac

SEQ ID NO: 3120 - DNA, 340 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccagggctgcgtcctaaccggcgtctgggtcatagcccacgagtgcggccaccacgccttcagcgactac

SEQ ID NO: 3121 - DNA, 346 bp, Artificial
  Mutation in BnaA.FAD2.a introduced by TALE nuclease pair BnFAD2_T01
caggatcatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccagggctgcgtcctaaccggcgtctgggtcatagcccacgagtgcggccaccacgccttcagcgactac

SEQ ID NO: 3122 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcggcctctctactgggcctgccagggctgcgtcctaacgggcctctgggtcatcgcccacgaatgcggccaccacgccttcagcgactac

SEQ ID NO: 3123 - DNA, 433 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcggctgtggccggtgctgtgccaggcccacggcttgaccccccagcaggtggtggccatcgccagcaatggcggtggcaacagccgctggaggcctggcctctctactgggcctgccagggctgcgtcctaaccggcgtctgggtcatagcccacgagtgcggccaccacgccttcagcgactac

SEQ ID NO: 3124 - DNA, 433 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcggctgttgccggtgctgtgccaggcccacggcttgaccccccagcaggtggtggccatcgccagcaatggcggtggcaacagccgctggaggcctggcctctctactgggcctgccagggctgcgtcctaaccggcgtctgggtcatagcccacgagtgcggccaccacgccttcagcgactac

SEQ ID NO: 3125 - DNA, 431 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttgccggtgctgtgccaggcgctcggtcgttcggctgcggcgagcggtatcagctcactcaaaggcggtaatacggttatcctggcctctctactgggcctgccagggctgcgtcctaaccggcgtctgggtcatagcccacgagtgcggccaccacgccttcagcgactac

SEQ ID NO: 3126 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccatctcctccctcaccctctctcctacttctggcctctctactgggcctgccagggctgcgtcctaaccggcgtctgggtcatagcccacgagtgcggccaccacgccttcagcgactac

SEQ ID NO: 3127 - DNA, 393 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctaacggtgcaggcgctgttgccggtgctgtgccaggcccacggcttgacccctggcctctctactgggcctgccaagggtgcgtcctaaccggcgtctgggtcatagcccacgagtgcggccaccacgccttcagcgactac

SEQ ID NO: 3128 - DNA, 350 bp, Artificial
  Mutation in BnaA.FAD2.a introduced by TALE nuclease pair BnFAD2_T01
caggatccatgggtgcaggtggcagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgaatgcggccaccacgccttcagcgactac

SEQ ID NO: 3129 - DNA, 334 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccaagggtgcgtcctaacgggcctctgggtcatagcccacgagtgcggccaccacgccttcagcgactac

SEQ ID NO: 3130 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcctttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaaccggcgtctgggtcatagcccacgagtgcggccaccacgccttcagcgactac

SEQ ID NO: 3131 - DNA, 341 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttactgggcctgccagggctgcgtcctaaccggcgtctgggtcatagcccacgagtgcggccaccacgccttcagcgactac

SEQ ID NO: 3132 - DNA, 348 bp, Artificial
  Mutation in BnaA.FAD2.a introduced by TALE nuclease pair BnFAD2_T01
caggatccatgggtgcaggtggaagaatgcaagtgtctcctcccaccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccgcctggcctctctactgggcctgccaagggtgcgtcctaaccggcgtctgggtcatagcccacgagtgcggccaccacgccttcagcgactac

SEQ ID NO: 3133 - DNA, 338 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattactgggcctgccagggctgcgtcctaaccggcgtctggggcatagcccacgagtgcggccaccacgccttcagcgactac

SEQ ID NO: 3134 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgctggcctctctactgggcctgccagggctgcgtcctaaccggcgtctgggtcatagcccacgagtgctgccaccacgccttcagcgactac

SEQ ID NO: 3135 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaaccggcgtctgggtcatagcccacgagtgcggccaccacgccttcagcgactac

SEQ ID NO: 3136 - DNA, 346 bp, Artificial
  Mutation in BnaA.FAD2.a introduced by TALE nuclease pair BnFAD2_T01
caggatccatgggtgcaggcggaagaatgcaagtgtctcctccctcccaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgagtgcggccaccacgccttcagcgactac

SEQ ID NO: 3137 - DNA, 332 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccaagggtgcgtcctaaccggcgtctgggtcatagcccacgagtgcggccaccacgccttcagcgactac

SEQ ID NO: 3138 - DNA, 356 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccagggctgcgtcctaaccggcgtctgggtcatagcccacgagtgcggccaccacgccttcagcgactac

SEQ ID NO: 3139 - DNA, 338 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattactgggcctgccagggctgcgtcctaacgggcctctgggtcatagcccacgagtgcggccaccacgccttcagcgactac

SEQ ID NO: 3140 - DNA, 349 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 3141 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgcgacatcatcatagcctcctgcttctactacgtcgccaccacttacttccctctcctccctcaccctctctcctactcctggcctctctactgggcctgccagggctgcgtcctaaccggcgtctgggtcatagcccacgagtgcggccaccacgccttcagcgactac

SEQ ID NO: 3142 - DNA, 339 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttactgggcctgccagggctgcgtcctaaccggcgtctgggtcatagcccacgagtgcggccaccacgccttcagcgactac

SEQ ID NO: 3143 - DNA, 387 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgccatcgtggctggcgatgaccaccacctgctcctggcctctctactgggcctgccaagggtgcgtcctaaccggcgtctgggtcatagcccacgagtgcggccaccacgccttcagcgactac

SEQ ID NO: 3144 - DNA, 332 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccagggctgcgtcctaaccggcgtctgggtcatagcccacgagtgcggccaccacgccttcagcgactac

SEQ ID NO: 3145 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgccagggctgcgtcctaaccggcgtctgggtcatagcccacgagtgcggccaccacgccttcagcgactac

SEQ ID NO: 3146 - DNA, 341 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccctctactgggcctgccagggctgcgtcctaaccggcgtctgggtcatagcccacgagtgcggccaccacgccttcagcgactac

SEQ ID NO: 3147 - DNA, 352 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctcccctactccgctggcctctctactgggcctgccagggctgcgtcctaaccggcgtctgggtcatagcccacgagtgcggccaccacgccttcagcgactac

SEQ ID NO: 3148 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctggcctctctactgggcctgccagggctgcgtcctaaccggcgtctgggtcatagcccacgagtgcggccaccacgccttcagcgactac

SEQ ID NO: 3149 - DNA, 331 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgggcctgccagggctgcgtcctaaccggcgtctgggtcataccccacgagtgcggccaccacgccttcagcgactac

SEQ ID NO: 3150 - DNA, 347 bp, Artificial
  Mutation in BnaA.FAD2.a introduced by TALE nuclease pair BnFAD2_T01
caggatccatgggtgcaggtggaagaatgcaagtgtatcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 3151 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttggcctctctactgggcctgccagggctgcgtcctaaccggcgtctgggtcatagcccacgagtgcggccaccacgccttcagcgactac

SEQ ID NO: 3152 - DNA, 347 bp, Artificial
  Mutation in BnaA.FAD2.a introduced by TALE nuclease pair BnFAD2_T01
caggatccatgggtgcaggtggaagaatgcaagtgtatcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgtttctactacgtcgccaccacttacttccctctcctccctcaccctctctcctactggcctctctactgggcctgccagggctgcgtcctaaccggcgtctgggtcatagcccacgagtgcggccaccacgccttcagcgactac

SEQ ID NO: 3153 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctctatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 3154 - DNA, 352 bp, Artificial
  Mutation in BnaA.FAD2.a introduced by TALE nuclease pair BnFAD2_T01
caggatccatgggtgcaggtggaagaatgcaagtgtctcgtccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccccttcgcctggcctctctactgggcctgccagggctgcgtcctaaccggcgtctgggtcatagcccacgagtgcggccaccacgccttcagcgactac

SEQ ID NO: 3155 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggggcctctctactgggcctgccagggctgcgtcctaaccggcctctgggtcatagcccacgagtgcggccaccacgccttcagcgactac

SEQ ID NO: 3156 - DNA, 354 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccttggcctctctacggggccggccagggctgcgtcctaaccggcgtctgggtcatagcccacgagggcggccaccacgccttcagcgactac

SEQ ID NO: 3157 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaaggctgcgtcctaacgggcctctgggtcatagcccacgagtgcggccaccacgccttcagcgactac

SEQ ID NO: 3158 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccagggctgtgtcctaaccggcgtctgggtcatagcccacgagtgcggccaccacgccttcagcgactac

SEQ ID NO: 3159 - DNA, 357 bp, Artificial
  Mutation in BnaA.FAD2.a introduced by TALE nuclease pair BnFAD2_T01
caggatccatgggtgcaggcggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccggtttgcgtattgccggtgcctggcctctctactgggcctgccaagggtgcgtcctaaccggcgtctgggtcatagcccacgagtgcggccaccacgccttcagcgactac

SEQ ID NO: 3160 - DNA, 416 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtcaggacatgatcgcagcgttccagagcgagattctccgcgctgtagaattcaccattgttgtgctggcctctctactgggcctgccagggctgcgtcctaaccggcgtctgggtcatagcccacgagtgcggccaccacgccttcagcgactac

SEQ ID NO: 3161 - DNA, 342 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgcttcaaacgctcgatccctcgctctttctcctacctcatctgggacatcatcatagcctcctgcttctactacgtcgccaccacttacttccctctcctccctcaccctctctcctactctctactgggcctgccaaggctgcgtcctaacgggcctctgggtcatcgcccacgaatgcggccaccacgccttcagcgactac

SEQ ID NO: 3162 - DNA, 340 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttactgggcctgccagggctgcgtcctaaccggcgtctgggtcatagcccacgagtgcggccaccacgccttcagcgactac

SEQ ID NO: 3163 - DNA, 312 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctgtgcgtcctaaccggcgtctgggtcatagcccacgagtgcggccaccacgccttcagcgactac

SEQ ID NO: 3164 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccagggctgcgtcctaacgggcctctgggtcatagcccacgagtgcggccaccacgccttcagcgactac

SEQ ID NO: 3165 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggccgctctactgggcctgccaaggctgcgtcctaacgggcctctgggtcatagcccacgagtgcggcctccacgccttcagcgactac

SEQ ID NO: 3166 - DNA, 352 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggcctctctactgggcctgccagggctgcgtcctaaccggcgtctgggtcatagcccacgagtgcggccaccacgccttcagcgactac

SEQ ID NO: 3167 - DNA, 332 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcagcctctctactgggcctgccaagggtgcgtcctaaccggcgtctgggtcatagcccacgagtgcggccaccacgccttcagcgactac

SEQ ID NO: 3168 - DNA, 358 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctcgcctggcctctctactgggcctgccaagggtgcgtcctaaccggcgtctgggtcatagcccacgagtgcggccaccacgccttcagcgactac

SEQ ID NO: 3169 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaacgtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgctggcctctctactgggcctgccagggctgcgtcctaaccggcgtctgggtcatagcccacgagtgcggccaccacgcctgcagcgactac

SEQ ID NO: 3170 - DNA, 350 bp, Artificial
  Mutation in BnaA.FAD2.a introduced by TALE nuclease pair BnFAD2_T01
caggatccatgggtgcaggtggaagaatgcaagtgtctcctcactccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 3171 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccaggactgcgtcctaaccggcgtctgggtcatagcccacgagtgcggccaccacgccttcagcgactac

SEQ ID NO: 3172 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgctagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgctggcctctctactgggcctgccagggctgcgtcctaaccggcgtctgggtcatagcccacgagtgcggccaccacgccttcagcgactac

SEQ ID NO: 3173 - DNA, 386 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggccaccacctgctggggggtcaagccgtgggcctggcacagtctctactgggcctgccagggctgcgtcctaaccggcgtctgggtcatagcccacgagtgcggccaccacgccttcagcgactac

SEQ ID NO: 3174 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccagggctgcgtcctaaccggcgtctgggtcatagcccacgagtgcggccaccacgccttcagcgactac

SEQ ID NO: 3175 - DNA, 354 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctggcctctctactgggcctgccaagggtgcgtcctaaccggcgtctgggtcatagcccacgagtgcggccaccacgccttcagcgactac

SEQ ID NO: 3176 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccagggctgcgtcctaacaggcgtctgggtcatagcccacgagtgcggccaccacgccttcagcgactac

SEQ ID NO: 3177 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgacccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 3178 - DNA, 325 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggctgcgtcctaaccggcgtctgggtcatagcccacgagtgcggccaccacgccttcagcgactac

SEQ ID NO: 3179 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagagcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccggggctgcgtcctaaccggcgtcggggtcatagcccccgagtgcggccaccacgccttcagcgactac

SEQ ID NO: 3180 - DNA, 347 bp, Artificial
  Mutation in BnaA.FAD2.a introduced by TALE nuclease pair BnFAD2_T01
caggatccatgggtgcaggtggcagaatgcaagtgtctccaccctccaacaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctggcctctctactgggcctgccagggctgcgtcctaaccggcgtctgggtcatagccctcgattgcggccaccacgccttcagcgactac

SEQ ID NO: 3181 - DNA, 387 bp, Artificial
  Mutation in BnaA.FAD2.a introduced by TALE nuclease pair BnFAD2_T01
caggatccatgggtgcaggtggcagaatgcaagtgtctcatccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcccccggagcagttggtggccatcgccagccacgattgcgcctggcctctctactgggcctgccagggctgcgtcctaaccggcctctgggtcatcgccaacgaatgcggccaccacgccatcagcgactac

SEQ ID NO: 3182 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcttcgcgcctggcctctctactgggcctgccaagggtgcgtcctaaccggcctctgggtcatcgcccacgaatgcggccaccacgccttcagcgactac

SEQ ID NO: 3183 - DNA, 387 bp, Artificial
  Mutation in BnaA.FAD2.a introduced by TALE nuclease pair BnFAD2_T01
caggatccatgggtgcaggtggaagaatgcaagtgtctccgccctccaaaaagactgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccccggagcaggtggtggccatcgccagccacgattgcgcctggcctctctacggggcctgccagggctgcgtccttaccggcctctgggtcatcgccctcgaatgcggccaccacgccatcagcgactac

SEQ ID NO: 3184 - DNA, 340 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctactctactgggcctgccagggctgcgtcctaaccggcgtctgggtcatagcccacgagtgcggccaccacgccttcagcgactac

SEQ ID NO: 3185 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaacgggcctctgggtcatagcccacgagtgcggccaccacgccttcagcgactac

SEQ ID NO: 3186 - DNA, 329 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtctgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgggcctgccagggctgcgtcctaacgggcctctgggtcatcgcccacgaatgcggccaccacgccttcagcgactac

SEQ ID NO: 3187 - DNA, 350 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 3188 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctcctggcctctctactgggcctgccagggctgcgtcctaaccggcgtctgggtcatagcccacgagtgcggccaccacgccttcagcgactac

SEQ ID NO: 3189 - DNA, 332 bp, Artificial
  Mutation in BnaA.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccagggctgcgtcctaaccggcgtctgggtcatagcccacgagtgcggccaccacgccttcagcgactac

SEQ ID NO: 3190 - DNA, 340 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttactgggcctgccagggctgcgtcctaaccggcgtctgggtcatagcccacgagtgcggccaccacgcattcagcgactac

SEQ ID NO: 3191 - DNA, 345 bp, Artificial
  Mutation in BnaA.FAD2.a introduced by TALE nuclease pair BnFAD2_T01
caggatccatgggtgcaggtggaagaatgcaagtctctcctccctccagctcccccggaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccctggcctctctactgggcctgccagggctgcgtcctaaccggcgtctgggtcatagcccacgagtgcggccaccacgccttcagcgactac

SEQ ID NO: 3192 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttcctctctactgggcctgccaagggtgcgtcctaacgggcctctgggtcatagcccacgagtgcggccaccacgccttcagcgactac

SEQ ID NO: 3193 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcgcctggcctctctactgggcctgccagggctgcgtcctaaccggcgtctgggtcatagcccacgagtgcggccaccacgccttcagcgactac

SEQ ID NO: 3194 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccatctctcctacttctggcctctctactgggcctgccagggctgcgtcctaaccggcgtctgggtcatagcccacgagtgcggccaccacgccttcagcgactac

SEQ ID NO: 3195 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcgccctctctcctacttggcctctctactgggcctgccagggctgcgtcctaaccggcgtctgggtcatagcccacgagtgcggccaccacgccttcagcgactac

SEQ ID NO: 3196 - DNA, 346 bp, Artificial
  Mutation in BnaA.FAD2.a introduced by TALE nuclease pair BnFAD2_T01
caggatccatgggtgcaggtggcagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccatggctgcgtcctaaccggcgtcggggtcatagcccacgagtgcggccaccacgccttcagcgactac

SEQ ID NO: 3197 - DNA, 350 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 3198 - DNA, 332 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcatagcccacgagtgcggccaccacgccttcagcgactac

SEQ ID NO: 3199 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgctcctactacgtcgccaccacttacttccctctcctccctcaccctctctcctacggcctctctactgggcctgccagggctgcgtcctaacgggcctctgggtcatagcccacgagtgcggccaccacgccttcagcgactac

SEQ ID NO: 3200 - DNA, 356 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcacccactctcctacttcgccgcctggcctctctacttggcctgccagggctgcgtcctaaccggcgtctgggtcatagcccacgagtgcggccaccacgccttcagcgactac

SEQ ID NO: 3201 - DNA, 347 bp, Artificial
  Mutation in BnaA.FAD2.a introduced by TALE nuclease pair BnFAD2_T01
caggatccatgggtgcaggtggaagaatgcaagtgtctcctccctcccaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaaggctgcgtcctaacgggcctctgggtcatagcccacgagtgcggccaccacgccttcagcgactac

SEQ ID NO: 3202 - DNA, 377 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgtgacatcatcatagcctcctgcttctactacgtcgccaccacttacttccctctcctccctcaccctctctcctacttcgcctccagcgcctgcttgccgccatcgtggctggcgatggccaccacctgctccggggtcaagccgtgagggctgggtcatagcccacgagtgcggccaccacgccttagcgactac

SEQ ID NO: 3203 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcgaataactcaagaaagcaatcccaccgcactgtttcaaacgctcgatacctcgctctttctcctacctcatctgggacatcatcatagcctcctgcttctactacgtcgcctccacttacttccctctcctccctcaccctctctcctttcctggcctctctactgggcctgccagggctgcgtcctaaccggcgtctgggtcatagcccacgagtgcggccaccacgccttcagcgactac

SEQ ID NO: 3204 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttccctctctactgggcctgccagggctgcgtcctaaccggcgtctgggtcatagcccacgagtgcggccaccacgccttcagcgactc

SEQ ID NO: 3205 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagcctgaaaccgacaacatcaagcgcgtaccctgcgagacaccgcccttcactgtcggagaactcaagaaagcaatcccaccgcactgtttcaaacgctctatccctcgctctttctcctacctcatctgggacatcatcatagcctcctgcttctactacgtcgccaccacttacttccctctcctccctcaccccctctccttctcctggcctctctactgggcctgccagggctgcgtcctaaccggcgtctgggtcatagcccacgagtgcggccaccacgccttcagcgactac

SEQ ID NO: 3206 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctggcctctctactgggcctgccagggctgcgtcctaaccggcgtctgggtcatagcccacgagtgcggcctccacgccatcagcgactac

SEQ ID NO: 3207 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctaaccctctctcctacttctggcctctctactgggcctgccaagggtgcgtcctaaccggcgtctgggtcatagcccacgagtgcggccaccacgccttcagcgactac

SEQ ID NO: 3208 - DNA, 398 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgccttggccacgctgcgatcatgtcctgatacttgacagcgacggtccctggcctctctactgggcctgccaagggtgcgtcctaaccggcgtctgggtcatagcccacgagtgcggccaccacgccttcagcgactac

SEQ ID NO: 3209 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccgcgagtgcggccaccacgccttcagcgactac

SEQ ID NO: 3210 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaactgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaacgggcctctgggtcatcgcccacgaatgcggccaccacgccttcagcgactac

SEQ ID NO: 3211 - DNA, 386 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttggccaccacctgctggggggtcaagccgtgggcctggcacagtctctactgggcctgccagggctgcgtcctaaccggcgtctgggtcatagcccacgagtgcggccaccacgccttcagcgactac

SEQ ID NO: 3212 - DNA, 348 bp, Artificial
  Mutation in BnaA.FAD2.a introduced by TALE nuclease pair BnFAD2_T01
caggatccatgggtgcaggtggaagaatgcaagtgtatcctccctccaaaaagtctgaaaccgacaacatcaagagcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacctcgcccctctactgggcctgccagggctgcgtcctaaccggcgtctgggtcatagcccacgagtgcggccaccacgccatcagcgactac

SEQ ID NO: 3213 - DNA, 356 bp, Artificial
  Mutation in BnaA.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcgcgcctggcctctctactgggcctgccagggctgcgtcctaaccggcgtctgggtcatagcccacgagtgcggccacacgccttcagcgactac

SEQ ID NO: 3214 - DNA, 321 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcaagggtgcgtcctaaccggcgtctgggtcatagcccacgagtgcggccaccacgccttcagcgactac

SEQ ID NO: 3215 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaatggcctctctactgggcctgccagggctgcgtcctaaccggcgtctgggtcatagcccacgagtgcggccaccacgccttcagcgactac

SEQ ID NO: 3216 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgcctctctactgggcctgccagggctgcgtcctaaccggcgtctgggtcatagcccacgagtgcggccaccacgccttcagcgactac

SEQ ID NO: 3217 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgagtgcggccaccacgccttcagcgactac

SEQ ID NO: 3218 - DNA, 358 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctaacctggcctctctactgggcctgccaagggtgcgtcctaaccggcgtctgggtcatagcccacgagtgcggccaccacgccttcagcgactac

SEQ ID NO: 3219 - DNA, 351 bp, Artificial
  Mutation in BnaA.FAD2.a introduced by TALE nuclease pair BnFAD2_T01
caggatccatgggtgcaggtggcagaatgcaagtgtatcctccctcccaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccagggctgcgtcctaaccggcgtctgtgtcatagcccacgagtgcggccaccacgccttcatcgactac

SEQ ID NO: 3220 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaaccaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 3221 - DNA, 450 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgaaaacggcttgtcccgcgtcatcggcgggggtcataacgtgactcccttaaggcagtgcatgcatggcgcaatgcactgacgggtgccccgctcaactttggcctctctactgggcctgccagggctgcgtcctaaccggcgtctgggtcatagcccacgagtgcggccaccacgccttcagcgactac

SEQ ID NO: 3222 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtccggcctctctactgggcctgccagggctgcgtcctaaccggcgtctgggtcatagcccacgagtgcggccaccacgccttcagcgactac

SEQ ID NO: 3223 - DNA, 350 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctggcctctctactgggcctgccagggctgcgtcctaacgggcctctgggtcatagcccacgagtgcggccaccacgccttcagcgactac

SEQ ID NO: 3224 - DNA, 350 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctccccctctctcctccccctggcctcgctcctgggcctgccagggctgcgtcctaacgggcctcggggtcatagcccacgagtgcggccaccacgccttcagcgactac

SEQ ID NO: 3225 - DNA, 342 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccaagggtgcgtcctaaccggcgtctgggtcatagcccacgagtgcggccaccacgccttcagcgactac

SEQ ID NO: 3226 - DNA, 338 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattactgggcctgccagggctgcgtcctaacgggcctctgggtcatagcccacgagtgcggccaccacgccttcagcgactac

SEQ ID NO: 3227 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcgctggcctctctactgggcctgccaaggatgcttcctaaccggcgtctgggtcatatcccacgagtgcggccaccacgccttcagcgactac

SEQ ID NO: 3228 - DNA, 300 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtctctctactgggcctgccagggctgcgtcctaaccggcgtctgggtcatagcccacgagtgcggccaccacgccttcagcgactac

SEQ ID NO: 3229 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcctctctactgggcctgccaaggctgcgtcctaacgggcctctgggtcatagcccacgagtgcggccaccacgccttcagcgactac

SEQ ID NO: 3230 - DNA, 332 bp, Artificial
  Mutation in BnaA.FAD2.a introduced by TALE nuclease pair BnFAD2_T01
caggatccatgggtgcaggtggaagaatgcaagtgtatcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccagggctgcgtcctaaccggcgtctgggtcatagcccacgagtgcggccaccacgccttcagcgactac

SEQ ID NO: 3231 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccagggctgcgtcctaaccggcgtctgggtcatagcccacaagtgcggccaccacgccatcagcgactac

SEQ ID NO: 3232 - DNA, 349 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 3233 - DNA, 318 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttggcaggcctctctactgggcctgccaagggtgcgtcctaaccggcgtctgggtcatagtccacgagtgcggccaccacgccttcagcgactac

SEQ ID NO: 3234 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacaccttcagcgactac

SEQ ID NO: 3235 - DNA, 350 bp, Artificial
  Mutation in BnaA.FAD2.a introduced by TALE nuclease pair BnFAD2_T01
caggatccatgggtgcaggtggaagaatgcaagtgtctccttcctccaaaaagtctgaaaccgacaacatcaagcgcgtaccctgcgagacaccgcccttcactgtcgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgctggcctctctactgggcctgccagggctgcgtcctaaccggcgtctgggtcatagcccacgagtgcggccaccacgccttcagcgactac

SEQ ID NO: 3236 - DNA, 354 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccttggcctctctactgggcctgccagggctgcgtcctaaccggcgtctgggtcatagcccacgagtgcggccaccacgccttcagcgactac

SEQ ID NO: 3237 - DNA, 348 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtccccggcgagacaccacccttcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 3238 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaactctctactgggcctgccaagggtgcgtcctaaccggcgtctgggtcatagcccacgagtgcggccaccacgccttcagcgactac

SEQ ID NO: 3239 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcgtggcctctctactgggcctgccagggctgcgtcctaaccggcgtctgggtcatagcccacgagtgcggccaccacgccttcagcgactac

SEQ ID NO: 3240 - DNA, 346 bp, Artificial
  Mutation in BnaA.FAD2.a introduced by TALE nuclease pair BnFAD2_T01
caggatccatgggtgcaggcggaagaatgcaagtgtctcctccctccaagaagactgaaaccgacaccatcaagcgcgtaccctgcgagacaccgcccttcactgtcggagaactcaagaaagcaatcacaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaactggcctctgggtcatagcccacgagtgcggccaccacgccttcagcgactac

SEQ ID NO: 3241 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgctggcctctctactgggcctgccaagggtgcgtcctaaccggcgtctgggtcatatcccacgagtgcggccaccacgccttcagcgactac

SEQ ID NO: 3242 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagcctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggtctgccagggctgcgtcctaacgggcctctgggtcatcgcccacgaatgcggccaccacgccttcagcgactac

SEQ ID NO: 3243 - DNA, 339 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctactgggcctgccaagggtgcgtcctaacctgcgtctgggtcatagcccgcgagtgcggccaccacgccttcagcgactac

SEQ ID NO: 3244 - DNA, 342 bp, Artificial
  Mutation in BnaA.FAD2.a introduced by TALE nuclease pair BnFAD2_T01
caggatccatgggtgcaggtggaagaatgcaagtgtctcctccatccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccaagggtgcgtcctaaccggcgtctgggtcatagcccacgagtgcggccaccacgcctgcagcgactac

SEQ ID NO: 3245 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctgcctctctactgggcctgccagggctgcgtcctaaccggcgtctgggtcatagcccacgagtgcggccaccacgccttcagcgacta

SEQ ID NO: 3246 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttcccttggcccctctactgggcctgccaaggctgcgtcctaacgggcctctgggtcatagcccacgagtgcggccaccacgccttcagcgactac

SEQ ID NO: 3247 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatcttggacatcatcatagcctcctgcttctactacgtcgccaccacttacttccctctcctccctcaccctctctcctacttgcctctctactgggcctgccagggctgcgtcctaacgggcctctgggtcatcgcccacgaatgcggccaccacgccttcagcgactac

SEQ ID NO: 3248 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 3249 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctactccgctggcctctctactgggcctgccagggctgcgtcctaaccggcgtctgggtcatagcccacgagtgcggccaccacgccttcagcgactac

SEQ ID NO: 3250 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctgtctcctacctcatctgggacatcatcatagcctcctgcttctactacgtcgccaccacttacttccctctcctccctcaccctctctcctacttttggcctctctactggtcctgccagggctgcgtcctaaccggcgtctgggtcatagcccacgagtgcggccaccactccttcagcgactac

SEQ ID NO: 3251 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggggcgtcctaaccggcgtctgggtcatagcccacgagtgcggccaccacgccttcagcgactac

SEQ ID NO: 3252 - DNA, 261 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatcccacgctccttctcctcttcgacatcatcatctcctcctcggctcctccctctaccacctctccacagcctacttccctctcccttaccacgccttcagcgactac

SEQ ID NO: 3253 - DNA, 349 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaataaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 3254 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctctccctctctcctgcttctggcctctctactgggcctgccagggctgcgtcctaacgggcctctgggtcatcgcccacgaatgcggccaccacgccttcagcgactac

SEQ ID NO: 3255 - DNA, 350 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 3256 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacaggcctctctactgggcctgccagggctgcgtcctaaccggcgtctgggtcatagcccacgagtgcggccaccacgccttcagcgactac

SEQ ID NO: 3257 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcttggcctctctactgggcctgccaaggctgcgtcctaacgggcctctgggtcatcgcccacgaatgcggccaccacgccttcagcgactac

SEQ ID NO: 3258 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcctagcctcctgcttctactacgtcgccaccacttacttccctctcctccctctccctctctccgacttctctactgggcctgccagggctgcgtcctaaccggcgtctgggtcatagcccacgagtgcggccaccacgccttcagcgactac

SEQ ID NO: 3259 - DNA, 423 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgtcccaggcccccggcttgaccccggagcaggtggtggccatcgccagccacgatggcggcaacagccgctggactggcctctctactgggcctgccaagggtgcgtcctaaccggcgtctgggtcatagcccacgagtgcggccaccacgccttcagcgactac

SEQ ID NO: 3260 - DNA, 440 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccccagcggctgttgccaccattattgctggcgatggccaccacctgctggggggtcaagccgtgggatcagggcgagataactgggcaacaatgctctccagcgccggcctctctactgggcctgccaagggtgcgtcctaaccggcgtctgggtcatagcccacgagtgcggccaccacgccttcagcgactac

SEQ ID NO: 3261 - DNA, 349 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 3262 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggcctgccaagggtgcgtcctaaccggcgtctgggtcatagcccacgagtgcggccaccacgccttcagcgactac

SEQ ID NO: 3263 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctactgggcctgccagggctgcgtcctaaccggcgtctgggtcatagcccacgagtgcggccaccacgccttcagcgactac

SEQ ID NO: 3264 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctatccggcgtctgggtcatagcccacgagtgcggccaccacgccttcagcgactac

SEQ ID NO: 3265 - DNA, 334 bp, Artificial
  Mutation in BnaA.FAD2.a introduced by TALE nuclease pair BnFAD2_T01
caggatccatgggtgcaggcggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccagggctgcgtcctaaccggcctctgggtcatagcccacgagtgcggccaccacgccttcagcgactac

SEQ ID NO: 3266 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacggcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 3267 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcctccctcaccctctctctggcctctctactgggcctgccaaggctgcgtcctaacgggcctctgggtcatagcccacgagtgcggccaccacgccttcagcgactac

SEQ ID NO: 3268 - DNA, 344 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccggcctctctactgggcctgccagggctgcgtcctaaccggcgtctgggtcatagcccacgagtgcggccaccacgccttcagcgactac

SEQ ID NO: 3269 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaacgggcctctgggtcatagcccacgagtgcggccaccacgccttcagcgactac

SEQ ID NO: 3270 - DNA, 387 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgccatcgtggctggcgatggccaccacctgctcctggcctctctactgggcctgccaagggtgcgtcctaaccggcgtctgggtcatagcccacgagtgcggccaccacgccttcagcgactac

SEQ ID NO: 3271 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcactcccaccgcactgtttcaaacgctcgatccctcgctctttctcctacctcatctgggacatcatcatagcctcctgcttctactacgtcgccaccacttacttccctctcctccctcaccctctctcctactgcgccggcctctctactgggcctgccagggctgcgtcctaaccggcgtctgggtcatagcccacgagtgcggccaccacgccttcagcgactac

SEQ ID NO: 3272 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctcctctctactgggcctgccagggctgcgtcctaaccggcgtctgggtcatagcccacgagtgcggccaccacgccttcagcgactac

SEQ ID NO: 3273 - DNA, 331 bp, Artificial
  Mutation in BnaA.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgggcctgccagggctgcgtcctaaccggcgtctgggtcatagcccacgagtgcggccaccacgccttcagcgactac

SEQ ID NO: 3274 - DNA, 346 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacggcctctctactgggcctgccagggctgcgtcctaaccggcgtctgggtcatagcccacgagtgcggccaccacgccttcagcgactac

SEQ ID NO: 3275 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccaagggtgcgtcctaaccggcgtctgggtcatagcccacgagtgcggccaccacgccttcagcgactac

SEQ ID NO: 3276 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatcgcccacgaatgcggccaccacgccttcagcgactac

SEQ ID NO: 3277 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatcgcccacgaatgcggccaccacgccttcagcgactac

SEQ ID NO: 3278 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgccctcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 3279 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgctggcctctctactgggcctgccagggctgcgtcctaaccggcgtctgggtcatagcccacgagtgcggccaccacgccttcagcgactac

SEQ ID NO: 3280 - DNA, 348 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 3281 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcataacctcctgcttctactacgtcgccaccacttacttccctctcctccctcaccctctctcccggcctctctactgggcctgccagggctgcgtcctaaccggcgtctgggtcatagcccacgagtgcggccaccacgccttcagcgactac

SEQ ID NO: 3282 - DNA, 342 bp, Artificial
  Mutation in BnaA.FAD2.a introduced by TALE nuclease pair BnFAD2_T01
caggatccatggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccagggctgcgtcctaaccggcgtctgggtcatagcccacgagtgcggccaccacgccttcagcgactac

SEQ ID NO: 3283 - DNA, 346 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctaaccggcgtctgggtcatagcccacgagtgcggccaccacgccttcagcgactac

SEQ ID NO: 3284 - DNA, 419 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcaggcgctgttgccggtgctgtgccaggcccacggcttgaccccccagcaggtggtggccatcgccagatggcctctctactgggcctgccaagggtgcgtcctaaccggcgtctgggtcatagcccacgagtgcggccaccacgccttcagcgactac

SEQ ID NO: 3285 - DNA, 356 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccgcccgtgcggccaccacgccttccccgtctcc

SEQ ID NO: 3286 - DNA, 348 bp, Artificial
  Mutation in BnaA.FAD2.a introduced by TALE nuclease pair BnFAD2_T01
caggatccatgggtgcagggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttccctctctactgggcctgccagggctgcgtcctaaccggcgtctgggtcatagcccacgagtgcggccaccacgccttcagcgactac

SEQ ID NO: 3287 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctgctgggcctgccagggctgcgtcctaaccggcgtctgggtcatagcccacgagtgcggccaccacgccttcagcgactac

SEQ ID NO: 3288 - DNA, 346 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatatcctcctgcttctactacgtcgccaccacttacttccctctcctccctcaccctctctcctacggcctctctactgggcctgccagggctgcgtcctaacgggcgtctgggtcatagcccacgagtgcggccaccacgccttcagcgactac

SEQ ID NO: 3289 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttcgctctcctccctcaccctctctcctaggcctctctactgggcctgccagggctgcgtcctaaccggcgtctgggtcatagcccacgagtgcggccaccacgccttcagcgactac

SEQ ID NO: 3290 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttggcctctctactgggcctgccaaggctgcgtcctaaccggcgtctgggtcatagcccacgagtgcggccaccacgccttcagcgactac

SEQ ID NO: 3291 - DNA, 356 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccagggctgcgtcctaaccggcgtctgggtcatagcccacgagtgcggccaccacgccttcagtgactac

SEQ ID NO: 3292 - DNA, 345 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactgtcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgagtgcggccaccacgccttcagcgacta

SEQ ID NO: 3293 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacgcctctctactgggcctgccagggctgcgtcctaaccggcgtctgggtcatagcccacgagtgcggccaccacgccttcagcgactac

SEQ ID NO: 3294 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctacttctactacgtcgccaccacttacttccctctcctccctcaccctctctcctacttatggcctctctactgggcctgccagggctgcgtcctaaccggcgtctgggtcatagcccacgagtgcggccaccacgccttcagcgactac

SEQ ID NO: 3295 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgaggcctctctactgggcctgccaaggctgcgtcctaacgggcctctgggtcatcgcccacgaatgcggccaccacgccttcagcgactac

SEQ ID NO: 3296 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaagccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 3297 - DNA, 358 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgggtctggcctctctactaggcctgccagggctgcgtcctaaccggcctctgggtcatagcccacgagtgcggccaccacgccttcagcgactac

SEQ ID NO: 3298 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccaagggtgcgtcctaaccggcgtctgggtcatagcccacgagtgcggccaccacgccttcagcgactac

SEQ ID NO: 3299 - DNA, 342 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaaacaatcccaccgcactgtttcaaacgctcgatccctcgctctttctcctacctcatctgggacatcatcatagcctcctgcttctactacgtcgccaccacttacttccctctcctccctcaccctcgcctggcctctctactgggcctgccaagggtgcgtcctaaccggcgtctgggtcatagcccacgagtgcggccaccacgccttcagcgactac

SEQ ID NO: 3300 - DNA, 342 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccagggctgcgtcctaacgggcctctgggtcatcgcccacgaatgcggccaccacgccttcagcgactac

SEQ ID NO: 3301 - DNA, 355 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccagggctgcgtcctaaccggcgtctgggtcatagcccacgagtgcggccaccacgccttcagcgactac

SEQ ID NO: 3302 - DNA, 347 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacaggcctctctactgggcctgccagggctgcgtcctaaccggcgtctgggtcatagcccacgagtgcgaccaccacgccatcagcgactac

SEQ ID NO: 3303 - DNA, 350 bp, Artificial
  Mutation in BnaA.FAD2.a introduced by TALE nuclease pair BnFAD2_T01
caggatccatgggtgcaggtggaagaatgcaagtctctcttccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 3304 - DNA, 352 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggcctctctactgggcctgccagggctgcgtcctaacgggcctctgggtcatagcccacgagtgcggccaccacgccttcagcgactac

SEQ ID NO: 3305 - DNA, 343 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgctaccacttacttccctctcctccctcaccctctctcctggcctctctactgggcctgccagggctgcgtcctaaccggcgtctgggtcatagcccacgagtgcggccaccacgccagcagcgactac

SEQ ID NO: 3306 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctactttggcctctctactgggcctgccagggctgcgtcctaaccggcgtctgggtcatagcccacgagtgcggccaccacgccttcagcgactac

SEQ ID NO: 3307 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggcgcgtcctaaccggcgtctgggtcatagcccacgagtgcggccaccacgccttcagcgactac

SEQ ID NO: 3308 - DNA, 424 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgtgccaggcccacggcttgaccccggagcaggtggtggccatcgccagccacgatggcggcaagcaggcgctggactggcctctctactgggcctgccagggctgcgtcctaacgggcctctgggtcatagcccacgagtgcggccaccacgccttcagcgactac

SEQ ID NO: 3309 - DNA, 341 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccctctactgggcctgccagggctgcgtcctaaccggcgtctgggtcatagcccacgagtgcggccaccacgccttcagcgactac

SEQ ID NO: 3310 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttactgggcctgccagggctgcgtcctaaccggcgtctgggtcatagcccacgagtgcggccaccacgccttcagcgactac

SEQ ID NO: 3311 - DNA, 340 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccagggctgcgtcctagcgggcctctgggtcatagcccacgagtgcggccaccacgccttcagcgactac

SEQ ID NO: 3312 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctctctactgggcctgccagggctgcgtcctaaccggcgtctgggtcatcgcccacgaatgcggccaccacgccttcagcgactac

SEQ ID NO: 3313 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacaggcctctctactgggcctgccaagggtgcgtcctaaccggcgtctgggtcatagcccacgagtgcggccaccacgccttcagcgactac

SEQ ID NO: 3314 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagcctgaaaccgacaacatcaagcgcgtaccctgcgagacaccccccttcactgtcggagaactcaagaaagcaatcccaccgcactgtttcaaacgctcgatccctcgctctttctcctacctcatctgggacatcatcatagcctcctgctcctactacgtcgccaccacttacttccctctcctccctcaccccctctggcctctctactgggcctgccaagggtgcgtcctaaccggcgtctgggtcatagcccacgagtgcggccaccacgccttcagcgactac

SEQ ID NO: 3315 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttcctctctactgggcctgccaagggtgcgtcctaaccggcgtctgggtcatagcccacgagtgcggccaccacgccttcagcgactac

SEQ ID NO: 3316 - DNA, 336 bp, Artificial
  Mutation in BnaA.FAD2.a introduced by TALE nuclease pair BnFAD2_T01
caggatccatgggtgcaggtggaagaatgcaagtgactcctccctccaaaaagtctgaaaccgacaacatcaagcgcgtaccctgcgagacaccgcccttcaccgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctgggcctgccaaggctgcgtcctaacgggcctctgggtcatcgcccacgaatgcggccaccacgccttcagcgactac

SEQ ID NO: 3317 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccaagggtgcgtcctaaccggcgtctgggtcatagcccacgagtgcggccaccacgccttcagcgactac

SEQ ID NO: 3318 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccaccagtgcggccaccacgccttcagcgactac

SEQ ID NO: 3319 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccccttacttccctctcctccctcaccctctctcctactcctggcctctctactgggcctgccagggctgcgtcctaacgggcctctgggtcatagcccacgagtgcggccaccacgccttcagcgactac

SEQ ID NO: 3320 - DNA, 350 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagagcggccaccacgccttcagcgactac

SEQ ID NO: 3321 - DNA, 346 bp, Artificial
  Mutation in BnaA.FAD2.a introduced by TALE nuclease pair BnFAD2_T01
caggatccatgggtgcagttggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccagggctgcgtcctaaccggcgtctgggtcatagcccacgagtgcggccaccacgccttcagcgactac

SEQ ID NO: 3322 - DNA, 340 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctgatctgggacatcatcatagcctcctgcttctactacgtcgccaccacttacttccctctcctccctcaccctctccctccctctactgggcctgccaaggctgcgtcctaaccggcgtctgggtcatagcccacgagtgcggccaccacgccttcagcgactac

SEQ ID NO: 3323 - DNA, 357 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctccgcccgcctggcctctctactgggcctgccagggctgcgtcctaaccggcgtctgggtcatagcccacgagtgcggccaccacgccttcagcgactac

SEQ ID NO: 3324 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcggctctctactgggcctgccaaggctgcgtcctaacgggcctctgggtcatcgcccacgaatgcggccaccacgcccttcagcgactac

SEQ ID NO: 3325 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcacgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 3326 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccagggctgcgtcctaaccggcgtctgggtcatatcccacgagtgcggccaccacgccttcagcgactac

SEQ ID NO: 3327 - DNA, 349 bp, Artificial
  Mutation in BnaA.FAD2.a introduced by TALE nuclease pair BnFAD2_T01
caggatccatgggtgcaggtggaagaatgcaagtgcctcctccctccaagaagtccgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactggtcctgccagggctgcgtcctaaccggcgtctgggtcatagcccacgagtgcggccaccacgccttcagcgactac

SEQ ID NO: 3328 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcgctggcctctctactgggcctgccagggctgcgtcctaaccggcgtctgggtcatagcccacgagtgcggccaccacgccttcagcgactac

SEQ ID NO: 3329 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctttcctggcctctctactgggcctgccaagggtgcgtcctaaccggcgtctgggtcatagcccacgagtgcggccaccacgccttcagcgactac

SEQ ID NO: 3330 - DNA, 347 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttacctctctactgggcctgccaagggtgcgtcctaaccggcgtctgggtcatagcccacgagtgcggccaccacgccttcagcgactac

SEQ ID NO: 3331 - DNA, 342 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccagggctgcgtcctaaccggcctctgggtcatagcccacgagtgcggccaccacgccttcagcgactac

SEQ ID NO: 3332 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctctctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgagtgcggccaccacgccttcagcgactac

SEQ ID NO: 3333 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttctcctggcctctctactgggcctgccagggctgcgtcctaaccggcgtctgggtcatagcccacgagtgcggccaccacgccttcagcgactac

SEQ ID NO: 3334 - DNA, 350 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccctcagcgactac

SEQ ID NO: 3335 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctccccctctcccctccccccctggcctctctactgggcctgccagggctgcgtcctaaccggcgtctgggtcatagcccacgagtgcggccaccacgccttcagcgactac

SEQ ID NO: 3336 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtccttaccggcgtctgggtcatagcccacgagtgcggccaccacgccttcagcgactac

SEQ ID NO: 3337 - DNA, 350 bp, Artificial
  Mutation in BnaA.FAD2.a introduced by TALE nuclease pair BnFAD2_T01
caggatccatgggtgcaggtggaagaatgcaagtgtctcgtccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 3338 - DNA, 334 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttccttccctctcctccctcaccctctctctactgggcctgccagggctgcgtcctaaccggcgtctgggtcatagcccacgagtgcggccaccacgccttcagcgactac

SEQ ID NO: 3339 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgtgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccaagggtgcgtcctaaccggcgtctgggtcatagcccacgagtgcggccaccacgccttcagcgactac

SEQ ID NO: 3340 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaaccccaccgcactgtttcaaacgctcgatccctcgctctttctcctacctcatctgggacatcatcatagcctcctgcttctactacgtcgccaccacttacttccctctcctccctcaccctctctcctacttccctctctactgggcctgccaagggtgcgtcctaaccggcgtctgggtcatagcccacgagtgcggccaccacgccttcagcgactac

SEQ ID NO: 3341 - DNA, 350 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttatggcctctctactgggcctgccagggctgcgtcctaaccggcgtctgggtcatagcccacgagtgcggccaccacgccttcagcgactac

SEQ ID NO: 3342 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgcctggcctctctactgggcctgccagggctgcgtcctaaccggcgtctgggtcatagcccacgagtgcggccaccacgccttcagcgactac

SEQ ID NO: 3343 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttagcctgccaagggtgcgtcctaaccggcgtctgggtcatagcccacgagtgcggccaccacgccttcagcgactac

SEQ ID NO: 3344 - DNA, 338 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattactgggcctgccagggctgcgtcctaaccggcgtctgggtcatagcccacgagtgcggccaccacgccttcagcgactac

SEQ ID NO: 3345 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctcctggcctctctactgggcctgccagggctgcgtcctaaccggcgtctgggtcatagcccacgagtgcggccaccacgccttcagcgactac

SEQ ID NO: 3346 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaacgggcctctgggtcatagcccacgagtgcggccaccacgccttcagcgactac

SEQ ID NO: 3347 - DNA, 348 bp, Artificial
  Mutation in BnaA.FAD2.a introduced by TALE nuclease pair BnFAD2_T01
caggatccatgggtgcaggtggaagaatgcaagtctctcctcccttcagctcccccgaaaccaaaaccctcaaacgcgtcccctgcgagacaccacccttcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctccgacttggcctctctactgggcctgccagggctgcgtcctaaccggcgtctgggtcatagcccgcgagtgcggccaccacgccatcagcgactac

SEQ ID NO: 3348 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaacgggcctctgggtcatcgcccacgaatgcggccaccacgccttcagcgactac

SEQ ID NO: 3349 - DNA, 356 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcactctttctcctacctcatctgggacatcatcatagcctcctgcttctactacgtcgccaccacttacttccctctcctccctcaccctctctcctacttcgccgcctggcctctctactgggcctgccagggctgcgtcctaaccgacgtctgggtcatagcccacgagtgcggccaccacgccttcagcgactac

SEQ ID NO: 3350 - DNA, 343 bp, Artificial
  Mutation in BnaA.FAD2.a introduced by TALE nuclease pair BnFAD2_T01
caggatccatgtgtgcaggtggaagaatgcaagtgtctcctccctccaaaaagtctgaaaccgacaacatcaagcgcgtaccctgcgagacaccgctcttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaacgggcctctgggtcatcgcccacgaatgcggccaccacgccttcagcgactac

SEQ ID NO: 3351 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagcctgaaaccgacaacatcaagcgcgtaccctgcgagacaccgcccttcactgtcggagaactcaagaaagcaatcccaccgcactgcttcaaacgctcgatccctcgctccttctcctacctcatctgggacatcatcatagcctcctgcttctactacgccgccaccacttacttccctctcctccctcgccctctctcctcccttggcctctctactgggcctgccagggctgcgtcctaaccggcgtctgggtcatagcccacgagtgcggccaccacgccttcagcgactac

SEQ ID NO: 3352 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcccctctactgggcctgccagggctgcgtcctaaccggcgtctgggtcatagcccacgagtgcggccaccacgccttcagcgactac

SEQ ID NO: 3353 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaacgggcctctgggtcatcgcccacgaatgcggccaccacgccttcagcgactac

SEQ ID NO: 3354 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctggcctctctactgggcctgccagggctgcgtcctaaccggcgtctgggtcatagcccacgagtgcggccaccacgccttcagcgactac

SEQ ID NO: 3355 - DNA, 429 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgggcgtcctgcccgccaccctccgggccgttgcttcacaccatcgtggctggcgatggccaccacctgctccggggtcatggcctctctactgggcctgccagggctgcgtcctaaccggcgtctgggtcatagcccacgagtgcggccaccacgccttcagcgactac

SEQ ID NO: 3356 - DNA, 350 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctactgcgggcctctctactgggcctgccaaggctgcgtcctaacgggcctctgggtcatagcccacgagtgcggccaccacgccttcagcgactac

SEQ ID NO: 3357 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgtgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccccctctcctacttcctctctactgggcctgccagggctgcgtcctaaccggcgtctgggtcatagcccacgagtgcggccaccacgccttcagcgactac

SEQ ID NO: 3358 - DNA, 335 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctactgggcctgccagggctgcgtcctaaccggcgtctgggtcatagcccacgagtgcggccaccacgccttcagcgactac

SEQ ID NO: 3359 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacatcatctgggacatcatcatagcctcctgcttctactacgtcgccaccacttacttccctctcctccctcaccctctctctggcctctctactgggcctgccagggctgcgtcctaaccggcgtctgggtcatagcccacgagtgcggccaccacgccttcagcgactac

SEQ ID NO: 3360 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctccctcatctgggacatcatcatagcctcctgcttctactacgtcgccaccacttacttccctctcctccctcaccctctctcctacttgcctctctactggtcctgccagggctgcgtcctaacctgcgtctgggtcatagcccaccagtgcggccaccacgccttcagcgactac

SEQ ID NO: 3361 - DNA, 340 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccagggcggcggcctaaccggcgtctgggtcatagcccacgagggcggccaccacgccatgagcgactac

SEQ ID NO: 3362 - DNA, 334 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcacccactctctactgggcctgccagggctgcgtcctaaccggcgtctgggtcatagcccacgagtgcggccaccacgccttcagcgactac

SEQ ID NO: 3363 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccagggctgcgtcctaaccggcgtctgggtcatagcccacgagtgcggccaccacgccttcagcgactac

SEQ ID NO: 3364 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttggcctctctactgggcctgccagggctgcgtcctaacgggcctctgggtcatagcccacgagtgcggccaccacgccttcagcgactac

SEQ ID NO: 3365 - DNA, 343 bp, Artificial
  Mutation in BnaA.FAD2.a introduced by TALE nuclease pair BnFAD2_T01
caggatccatgggtgcaggtggaagaatgcaagtgtctccttcctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccaagggtgcgtcctaaccggcgtctgggtcatagcccacgagtgcggccaccacgccttcagcgactac

SEQ ID NO: 3366 - DNA, 342 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcgcctggcctctctactgggcctgccagggctgcgtcctaacgggcctctgggtcatagcccacgagtgcggccaccacgccttcagcgactac

SEQ ID NO: 3367 - DNA, 312 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctgtgcgtcctaaccggcgtctgggtcatagcccacgagtgcggccaccacgccttcagcgactac

SEQ ID NO: 3368 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgctggcctctctactgggcctgccagggctgcgtcctaaccggcgtctgggtcatagcccacgagtgcggccaccacgccttcagcgactac

SEQ ID NO: 3369 - DNA, 331 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgggcctgccagggctgcgtcctaaccggcgtctgggtcatagcccacgagtgcggccaccacgccttcagcgactac

SEQ ID NO: 3370 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaaggctgcgtcctaacgggcctctgggtcatagcccacgagtgcggccaccacgccttcagcgactac

SEQ ID NO: 3371 - DNA, 343 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccagggctgcgtcctaaccggcgtctgggtcatagcccacgagtgcggccaccacgccttcagcgactac

SEQ ID NO: 3372 - DNA, 339 bp, Artificial
  Mutation in BnaA.FAD2.a introduced by TALE nuclease pair BnFAD2_T01
caggatccatgggtgaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttactgggcctgccagggctgcgtcctaaccggcgtctgggtcatagcccacgagtgcggccaccacgccttcagcgactac

SEQ ID NO: 3373 - DNA, 332 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccagggctgcgtcctaaccggcgtctgggtcatagcccacgagtgcggccaccacgccttcagcgactac

SEQ ID NO: 3374 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcccgcctggcctctctactgggcctgccagggctgcgtcctaacgggcctctgggtcatcgcccacgaatgcggccaccacgccttcagcgactac

SEQ ID NO: 3375 - DNA, 356 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccagggctgcgtcctaacgggcctctgggtcatagcccacgagtgcggccaccacgccttcagcgactac

SEQ ID NO: 3376 - DNA, 309 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctccatcccacgctccttctcctcttcgacatcatcatctcctcctcggctcctccctcaccctctctccttggcctctctactgggcctgccaagggtgcgtcctaaccggcgtctgggtcatagcccacgagtgcggccaccacgccttcagcgactac

SEQ ID NO: 3377 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccagggctgcgtcctaaccggcgtctgggtcatagcccacgagtgcggccaccacgccttcagcgactac

SEQ ID NO: 3378 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcggcctctctactgggcctgccagggctgcgtcctaactggcctctgggtcatcgcccacgaatgcggccaccacgccttcagcgactac

SEQ ID NO: 3379 - DNA, 351 bp, Artificial
  Mutation in BnaA.FAD2.a introduced by TALE nuclease pair BnFAD2_T01
caggatccatgggtgcaggtggaagaatgcaagtgcctaatccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccagggctgcgtcctaaccggcgtctgggtcatagcccacgagtgcggccaccacgccttcagcgactac

SEQ ID NO: 3380 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctaggcctctctactgggcctgccagggctgcgtcctaaccggcgtctgggtcatagcccacgagtgcggccaccacgccttcagcgactac

SEQ ID NO: 3381 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatcctctctactgggcctgccagggctgcgtcctaaccggcgtctgggtcatagcccacgagtgcggccaccacgtcttcagcgactac

SEQ ID NO: 3382 - DNA, 349 bp, Artificial
  Mutation in BnaA.FAD2.a introduced by TALE nuclease pair BnFAD2_T01
caggatccatgggtgcaggtggaagaatgcaagtgtctcctcccccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 3383 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtcttaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 3384 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagtagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcgcctctctactgggcctgccagggctgcgtcctaaccggcgtctgggtcatagcccacgagtgcggccaccacgccttcagcgactac

SEQ ID NO: 3385 - DNA, 357 bp, Artificial
  Mutation in BnaA.FAD2.a introduced by TALE nuclease pair BnFAD2_T01
caggatccatgggtgcaggtgtaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcccgcctggcctctctactgggcctgccagggctgcgtcctaaccggcgtctgggtcatagcccacgagtgcggccaccacgccttcagcgactac

SEQ ID NO: 3386 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctctcctacttcctctctactgggcctgccagggctgcgtcctaaccggcgtctgggtcatagcccacgagtgcggccaccacgccttcagcgactac

SEQ ID NO: 3387 - DNA, 334 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctgccaagggtgcgtcctaaccggcgtctgggtcatagcccacgagtgcggccaccacgccttcagcgactac

SEQ ID NO: 3388 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccagggctgcgtcctaaccggcgtctgggtcatagcccacgagtgcggccaccacgccttcagcgactac

SEQ ID NO: 3389 - DNA, 352 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccgccctggcctctctactgggcctgccagggctgcgtcctaaccggcgtctgggtcatagcccacgagtgcggccaccacgccttcagcgactac

SEQ ID NO: 3390 - DNA, 277 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcgccttcagcgactac

SEQ ID NO: 3391 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaacgggcgtctgggtcatagcccacgagtgcggccaccacgccttcagcgactac

SEQ ID NO: 3392 - DNA, 355 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccagggctgcgtcctaacgggcctctgggtcatcgcccacgaatgcggccaccacgccttcagcgactac

SEQ ID NO: 3393 - DNA, 354 bp, Artificial
  Mutation in BnaA.FAD2.a introduced by TALE nuclease pair BnFAD2_T01
caggatccagggtgcaggtggaagaatgcaagtgtccccttccctcaaaaaggctgaaaccgacaacattaagcgcgtaccctgcgagacaccgcccttcactgtcggagaactcaagaaagcaatcccaccgcactggttcaaacgctccatccctccctctttctcctacctcatctgggacatcatcatagcctcctgcttctactacgccgccacccctcactcccctctcctccctcaccccctctccccctccgcccctggcctctctactgggcctgccagggctgcgtcctaaccggcgtctgggtcatagcccacgagtgcggccaccacgccttcagcgactac

SEQ ID NO: 3394 - DNA, 342 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctactctctactgggcctgccagggctgcgtcctaaccggcgtctgggtcatagcccacgagtgcggccaccacgccttcagcgactac

SEQ ID NO: 3395 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccagggctgcgtcctaaccggcgtctgggtcatagcccacgagtgcggccaccgcgccttcagcgactac

SEQ ID NO: 3396 - DNA, 350 bp, Artificial
  Mutation in BnaA.FAD2.a introduced by TALE nuclease pair BnFAD2_T01
caggatccatgggtgcaggtggaagagtgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 3397 - DNA, 352 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatcccacgctccttctcctacctcatctgggacatcatcatagcctcctgcttctactacgtcgccaccacttacttccctctcctccctcaccctctctcctaccgccctggcctctctactgggcctgccagggctgcgtcctaaccggcgtctgggtcatagcccacgagtgcggccaccacgccttcagcgactac

SEQ ID NO: 3398 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctaccacatctgggacatcatcatagcctcctgcttctactacgtcgccaccacttacttccctctcctccctcaccctctctctggcctctctactgggcctgccagggctgcgtcctaaccggcgtctgggtcatcgcccacgaatgcggccaccacgccttcagcgactac

SEQ ID NO: 3399 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccctggcctctctactgggcctgccagggctgcgtcctaaccggcgtctgggtcatagcccacgagtgcggccaccacgccttcagcgactac

SEQ ID NO: 3400 - DNA, 346 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgagtgcggccaccacgccttcagcgactac

SEQ ID NO: 3401 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacggcctctctactgggcctgccagggctgcgtcctaaccggcgtctgggtcatagcccacgagtgcggccaccacgccttcagcgactac

SEQ ID NO: 3402 - DNA, 401 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcggtccagcgcctgcttgccaccattattgctggcgatggccaccacctgctgggcctctctactgggcctgccaagggtgcgtcctaaccggcgtctgggtcatagcccacgagtgcggccaccacgccttcagcgactac

SEQ ID NO: 3403 - DNA, 347 bp, Artificial
  Mutation in BnaA.FAD2.a introduced by TALE nuclease pair BnFAD2_T01
caggatccatgggtgcaggtggaagaatgcaagtgtctccttcctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttccctctctactgggcctgccagggctgcgtcctaaccggcgtctgggtcatagcccacgagtgcggccaccacgccttcagcgactac

SEQ ID NO: 3404 - DNA, 358 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgggtctggcctctctactaggcctgccagggctgcgtcctaaccggcgtctgggtcatagcccacgagtgcggccaccacgccttcagcgactac

SEQ ID NO: 3405 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccagggctgcgtccttaccggcgtctgggtcatagcccacgattgcggccaccacgccttcagcgactac

SEQ ID NO: 3406 - DNA, 347 bp, Artificial
  Mutation in BnaA.FAD2.a introduced by TALE nuclease pair BnFAD2_T01
caggatacatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccagggctgcgtcctaaccggcgtctgggtcatagcccacgagtgcggccaccacgccgtcagcgactac

SEQ ID NO: 3407 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctctcctgcctctctactgggcctgccagggctgcgtcctaacgggcctctgggtcatagcccacgagtgcggccaccacgccttcagcgactac

SEQ ID NO: 3408 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggccggccagggctgcgtccgaaccggcgtctgggtcatagcccacgattgcggccaccacgccatcagcgactac

SEQ ID NO: 3409 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccagggctgcgtcctaaccggcgtctgggtcatagcccacgagtgcggccaccacgccttcagcgactaa

SEQ ID NO: 3410 - DNA, 342 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgccctttctcctacctcatctgggacatcatcatagcctcctgcttctactacgtcgccaccacttacttccctctcctccctcaccctctctcctactctctactgggcctgccagggctgcgtcctaaccggcgtctgggtcatagcccacgagtgcggccaccacgccttcagcgactac

SEQ ID NO: 3411 - DNA, 417 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcttcgtcaggacatgatcgcagcgttgccagagcgagattctccgcgctgtagaagtccccattgttgtgctggcctctctactgggcctgccagggctgcgtcctaaccggcgtctgggtcatagcccacgagtgcggccaccacgcctccagcgactac

SEQ ID NO: 3412 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccagggctgcgtcctaacgggcctctgggtcatagcccacgagtgcggccaccacgccttcagcgactac

SEQ ID NO: 3413 - DNA, 343 bp, Artificial
  Mutation in BnaA.FAD2.a introduced by TALE nuclease pair BnFAD2_T01
caggatccatgggtgcaggtggcagaatgcaagtgtctcctccatccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctggcctctctactgggcctgccagggctgcgtcctaacgggcctctgggtcatagcccacgagtgaggccaccacgccttcagcgactac

SEQ ID NO: 3414 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgggcctgccagggctgcgtcctaacgggcctctgggtcatcgcccacgaatgcggccaccacgccttcagcgactac

SEQ ID NO: 3415 - DNA, 352 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccacttcgcctggcctctctactgggcctgccagggctgcgtcctaaccggcgtctgggtcatagcccacgagtgcggccaccacgccttcagcgactac

SEQ ID NO: 3416 - DNA, 339 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttactgggcctgccagggctgcgtcctaaccggcgtctgggtcatagcccacgagtgcggccaccacgccttcagcgactac

SEQ ID NO: 3417 - DNA, 329 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgggcctgccagggctgcgtcctaacgggcctctgggtcatagcccacgagtgcggccaccacgccttcagcgactac

SEQ ID NO: 3418 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacaggcctctctactgggcctgccagggctgcgtcctaacgggcctctgggtcatagcccacgagtgcggccaccacgccttcagcgactac

SEQ ID NO: 3419 - DNA, 329 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgggcctgccagggctgcgtcctgaccggcgtctgggtcatagcccacgagtgcggccaccacgccttcagcgactac

SEQ ID NO: 3420 - DNA, 386 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcataccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggccaccacctgctggggggtcaagccgtgggcctggcacagtctctactgggcctgccagggctgcgtcctaaccggcgtctgggtcatagcccacgagtgcggccaccacgccttcagcgactac

SEQ ID NO: 3421 - DNA, 347 bp, Artificial
  Mutation in BnaA.FAD2.a introduced by TALE nuclease pair BnFAD2_T01
caggatccatgggtgcaggtcgaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttacctctctactgggcctgccaagggtgcgtcctaaccggcgtctgggtcatagcccacgagtgcggccaccacgccttcagcgactac

SEQ ID NO: 3422 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctctggcccctctactgggcctgccaaggctgcgtcctaacgggcctctgggtcatcgcccacgagtgcggccaccacgccttcagcgactac

SEQ ID NO: 3423 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccagggctgcgtcctaacgggcctctgggtcatcgcccacgaatgcggccaccacgccttcagcgactac

SEQ ID NO: 3424 - DNA, 349 bp, Artificial
  Mutation in BnaA.FAD2.a introduced by TALE nuclease pair BnFAD2_T01
caggatccatgggtgcaggtggaagaatgcaagtatctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccgtcgtctgggtcatagcccacgagtgcggccacgacgccttcagcgactac

SEQ ID NO: 3425 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcttccggcctctctactgggcctgccaagggtgcgtcctaaccggcgtctgggtcatagcccacgagtgcggccaccacgccttcagcgactac

SEQ ID NO: 3426 - DNA, 349 bp, Artificial
  Mutation in BnaA.FAD2.a introduced by TALE nuclease pair BnFAD2_T01
caggatccatgggtgcaggtggaagaatgcaagtgtctcctcactccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctctggcctctctactgggcctgccaagggtgcgtcctaaccggcgtctgggtcatagcccacgagtgcggccaccacgcctgcagcgactac

SEQ ID NO: 3427 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccctggcctctctactgggcctgccagggctgcgtcctaaccggcgtctgggtcatagcccacgagtgcggccaccacgccttcagcgactac

SEQ ID NO: 3428 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaacgggcctctgggtcatcgcccacgaatgcggccaccacgccttcagcgactac

SEQ ID NO: 3429 - DNA, 385 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccccgtgggcctggcacagcaccggcaacagccgctggaccgtctccagcgcctgcctggcctctctactgggcctgccaagggtgcgtcctaaccggcgtctgggtcatagcccacgaatgcggccaccacgccttcagcgactac

SEQ ID NO: 3430 - DNA, 355 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttcgcgcctggcctctctactgggcctgccagggctgcgtcctaaccggcgtctgggtcatagcccacgagtgcggccaccacgccttcagcgactac

SEQ ID NO: 3431 - DNA, 455 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggaccgcctccagcgcctgcttgccgccatcgtggctggcgatggccaccacctgctccggggtcaagccgtgggcctggcacagcaccggcaacagccgcctggcccctctactgggcctgccaaggctgcgtcctaacgggcctctgggtcatcgcccacgaatgcggccaccacgccttcagcgactac

SEQ ID NO: 3432 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctacgtcgccaccacttacttccctctcctccctcaccctctctcctcctttggcctctctactgggcctgccagggctgcgtcctaaccggcgtctgggtcatagcccacgagtgcggccaccacgccttcagcgactac

SEQ ID NO: 3433 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgagacatcatcatagcctcctgcttctactacgtcgccaccacttacttccctctcctccctcaccctctctcctacttggcctctctactgggcctgccaagggtgcgtcctaacgggcctctgggtcatcgcccacgaatgcggccaccacgccttcagcgactac

SEQ ID NO: 3434 - DNA, 350 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaacgggcctctgggtcatagcccacgagtgcggccaccacgccttcagcgactac

SEQ ID NO: 3435 - DNA, 357 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctccccccgcctggcctctctactgggcctgccagggctgcgtcctaaccggcgtctgggtcatagcccacgagtgcggccaccacgccttcagcgactac

SEQ ID NO: 3436 - DNA, 345 bp, Artificial
  Mutation in BnaA.FAD2.a introduced by TALE nuclease pair BnFAD2_T01
caggatccattgcaggtggaagaatgcaagtgtctcctccctccaaaaagtctgaaaccgacaacatcaagcgcgtaccctgcgagacaccgcccttcactgtcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacatggcctctctactgggcctgccaagggtgcgtcctcaccggcgtctgggtcatagcccacgagtgcggccaccacgccttcagcgactac

SEQ ID NO: 3437 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccagggctgcgtcctaacgggcctcttggtcatcgcccacgaatgcggccaccacgccttcagcgactac

SEQ ID NO: 3438 - DNA, 334 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccagggctgcgtcctaacgggcgtctgggtcatagcccacgagtgcggccaccacgccttcagcgactac

SEQ ID NO: 3439 - DNA, 348 bp, Artificial
  Mutation in BnaA.FAD2.a introduced by TALE nuclease pair BnFAD2_T01
caggatccatgggtgcaggtggaagaatacaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 3440 - DNA, 318 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttggcaggcctctctactgggcctgccatggctgcgtcctaaccggcgtctgggtcatagcccacgagtgcggccaccacgccttcagcgactac

SEQ ID NO: 3441 - DNA, 349 bp, Artificial
  Mutation in BnaA.FAD2.a introduced by TALE nuclease pair BnFAD2_T01
cagggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcggcctaaccggcgtctgggtcatagcccacgagtgcggccaccacgccttcagcgactac

SEQ ID NO: 3442 - DNA, 348 bp, Artificial
  Mutation in BnaA.FAD2.a introduced by TALE nuclease pair BnFAD2_T01
caggatccatgggtgcaggtggaagaatgcaagtgtatcctccctccaaaaagactgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggccttcgagggctgcgtcctaaccggcgtctgggtcatagcccacaagtgcggccaccacggcttcagcgactac

SEQ ID NO: 3443 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctccctggcccctctactgggcctgccagggctgcgtcctaaccggcgtctgggtcatagcccacgagtgcggccaccacgccttcagcgactac

SEQ ID NO: 3444 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcaccatagcctcctgcttctactacgtcgccaccacttacttccctctcctccctcaccctctctcaggcctctctactgggcctgccaagggtgcgtcctaaccggcgtctgggtcatagcccacgagtgcggccaccacgccttcagcgactac

SEQ ID NO: 3445 - DNA, 348 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaacgggcctctgggtcatagcccacgagtgcggccaccacgccttcagcgactac

SEQ ID NO: 3446 - DNA, 378 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctccagcgcctgcttgccgccatcgtggctggcgatggccaccacctgctccggggtcaagccgtgagggctgggtcatagcccacgagtgcggccaccacgccttcagcgactac

SEQ ID NO: 3447 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgtgcctgccaagggtgcgtcctaaccggcgtcggggtcatagcccacgagtgcggccaccacgccttcagcgactac

SEQ ID NO: 3448 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccagggctgcgtcctaaccggcgtctgggtcatagcccacgagtgctgccaccacgccttcagcgactac

SEQ ID NO: 3449 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccagggctgcgtcctaaccggcgtctgggtcatagcccacgagggcggccaccacgccttcagcgactac

SEQ ID NO: 3450 - DNA, 431 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgttgccggtgctgtgccaggcgctcggtcgttcggctgcggcgggcggtatcagctcactcaaaggcggtaatacggttatcctggcctctctactgggcctgccagggctgcgtcctaaccggcgtctgggtcatagcccacgagtgcggccaccacgccttcagcgactac

SEQ ID NO: 3451 - DNA, 338 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccctctctactgggcctgccaagggtgcgtcctaaccggcgtctgggtcatagcccacgagtgcggccaccacgccttcagcgactac

SEQ ID NO: 3452 - DNA, 332 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccagggctgcgtcctaaccggcgtctgggtcatagcccacgagtgcggccactacgccttcagcgactac

SEQ ID NO: 3453 - DNA, 334 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgtcaagggtgcgtcctaaccggcgtctgggtcatagcccacgagtgcggccaccacgccttcagcgactac

SEQ ID NO: 3454 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcggcctctctactgggcctgccaagggtgcgtcctaaccggcgtctgggtcatagcccacgagtgcggccaccacgccttcagcgactac

SEQ ID NO: 3455 - DNA, 345 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccagggctgcgtcctgaccggcgtctgggtcatagcccacgagtgcggccaccacgccttcagcgactac

SEQ ID NO: 3456 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccagggctgcgtcctaaccggcgtctgggtcatagcccacgagtgcggccaccacgccttcagcgactac

SEQ ID NO: 3457 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttgcctctctactgggcctgccagggctgcgtcctaaccggcgtctgggtcatagcccacgagtgcggccaccacgccttcagcgactac

SEQ ID NO: 3458 - DNA, 334 bp, Artificial
  Mutation in BnaA.FAD2.a introduced by TALE nuclease pair BnFAD2_T01
caggatccatgggtgcaggtggaagaatgcaagtgtctcctccctccaagaagtctgaaacctacaacatcaaactcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcacccactctctactgggcctgccagggctgcgtcctaaccggcgtctgggtcatcgcccacgaatgcggccaccacgccttcagcgactac

SEQ ID NO: 3459 - DNA, 353 bp, Artificial
  Mutation in BnaA.FAD2.a introduced by TALE nuclease pair BnFAD2_T01
gcaggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggcctctctactgggcctgccagggctgcgtcctaaccggcgtctgggtcatagcccacgagtgcggccaccacgccttcagcgactac

SEQ ID NO: 3460 - DNA, 348 bp, Artificial
  Mutation in BnaA.FAD2.a introduced by TALE nuclease pair BnFAD2_T01
caggatccattggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 3461 - DNA, 346 bp, Artificial
  Mutation in BnaA.FAD2.a introduced by TALE nuclease pair BnFAD2_T01
caggatccatgggtgcaggtggaagaatgaaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgtttctactacgtcgccaccacttacttccctctcctccctcaccctctctcctatggcctctctactgggcctgccagggctgcgtcctaaccggcgtctgggtcatagcccacgagtgcggccaccacgccttcagcgactac

SEQ ID NO: 3462 - DNA, 409 bp, Artificial
  Mutation in BnaA.FAD2.a introduced by TALE nuclease pair BnFAD2_T01
caggatccatgggtgcaggtggaagaatgcaagtgtctcctccctccaagaagtccgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggagacggtgcaggcgctgttgccggtgctgtgccaggcccacggcttgacccccctggcctctctactgggcctgccagggctgcgtcctaaccggcgtctgggtcatagcccacgagtgcggccaccacgccttcagcgactac

SEQ ID NO: 3463 - DNA, 343 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccagggctgcgtcctaaccggcgtctgggtcatagcccacgagtgcggccaccacgccttcagcgactac

SEQ ID NO: 3464 - DNA, 343 bp, Artificial
  Mutation in BnaA.FAD2.a introduced by TALE nuclease pair BnFAD2_T01
caggatacatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccagggctgcgtcctaaccggcgtctgggtcatagcccacgagtgcggccaccacgccttcagcgactac

SEQ ID NO: 3465 - DNA, 340 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccaagggtgcgtcctaaccggcgtctgggtcatagcccacgagtgcggccaccacgccttcagcgactac

SEQ ID NO: 3466 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcgccctctctactgggcctgccaagggtgcgtcctaaccggcgtctgggtcatagcccacgagtgcggccaccacgccttcagcgactac

SEQ ID NO: 3467 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaacggcgtctgggtcatagcccacgagtgcggccaccacgccttcagcgactac

SEQ ID NO: 3468 - DNA, 347 bp, Artificial
  Mutation in BnaA.FAD2.a introduced by TALE nuclease pair BnFAD2_T01
caggatccattggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacaggcctctctactgggcctgccagggctgcgtcctaaccggcgtctgggtcatagcccacgagtgcggccaccacgccttcagcgactac

SEQ ID NO: 3469 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatcttggacatcatcatagcctcctgcttctactacgtcgccaccacttacttccctctcctccctcaccctctctcctacttggcctctttactgggcctgccaagggtgcgtcctaaccggcgtctgggtcatagcccacgagtgcggccaccacgccttcagcgactac

SEQ ID NO: 3470 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctccttctgccctctctacggggcctgccaggcctgcgtcctacccggcgtcggggtcatagcccacgagggcggccaccacgccttcaccgactcc

SEQ ID NO: 3471 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagcctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 3472 - DNA, 354 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccttggcctctctactgggcctgccagggctgcgtcctaaccggcgtctgggtcatagcccacgagtgcggccacaacgccttcagcgactac

SEQ ID NO: 3473 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccagggctgcgtcctaaccggcgtctgggtcatagcccacgagtgcggccaccacgccttcagcgactaa

SEQ ID NO: 3474 - DNA, 349 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctggcctctctactgggcctgccagggctgcgtcctaaccggcgtctgggtcatagcccacgagtgcggccaccacgccttcagcgactac

SEQ ID NO: 3475 - DNA, 330 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctccgggcctgccagggctgcgtcctaaccggcgtctgggtcatagcccacgagtgcggccaccacgcctcagcgactac

SEQ ID NO: 3476 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccacactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 3477 - DNA, 341 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttactgggcctgccagggctgcgtcctaaccggcgtctgggtcatagcccacgagtgcggccaccacgccttcagcgactac

SEQ ID NO: 3478 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctggcctctctactgggcctgccagggctgcgtcctaaccggcgtcggggtcatagcccacgagtgcggccaccacgccttcagcgactac

SEQ ID NO: 3479 - DNA, 342 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccctgtctctctactgggcctgccaagggtgcgtcctaaccggcgtctgggtcatagcccacgagtgcggccaccacgccttcagcgactac

SEQ ID NO: 3480 - DNA, 339 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttactgggcctgccagggctgcgtcctaaccggcgtctgggtcatagcccacgagtgcggccaccacgccttcagcgactac

SEQ ID NO: 3481 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccaagggtgcgtcctaaccggcgtctgggtcatagcccacgagtgcggccaccacgccttcagcgactac

SEQ ID NO: 3482 - DNA, 449 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgccaggcccacggcttgaccccggagcaggtggtggccatcgccagcaatggcggtggcaagcaggcgctggagacggtccagcggctgttgccggtgctggcctctctactgggcctgccaagggtgcgtcctaaccggcgtctgggtcatagcccacgagtgcggccaccacgccttcagcgactac

SEQ ID NO: 3483 - DNA, 339 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccggcctgccagggctgcgtcctaaccggcgtctgggtcatagcccacgagtgcggccaccacgccttcagcgactac

SEQ ID NO: 3484 - DNA, 417 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtcaggacatgatcgcagcgttgccagagcgagattctccgcgctgtagaagtcaccattgttgtgctggcctctctactgggcctgccagggctgcgtcctaaccggcgtctgggtcatagcccacgagtgcggccaccacgccttcagcgactac

SEQ ID NO: 3485 - DNA, 386 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggccaccacctgctggggggtcaagccgtgggcctggcacagtctctactgggcctgccagggctgcgtcctaaccggcgtctgggtcatcgcccacgaatgcggccaccacgccttcagcgactac

SEQ ID NO: 3486 - DNA, 334 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaacctacaacatcaaactcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcacccactctctactgggcctgccagggctgcgtcctaaccggcgtctgggtcatagcccacgagtgcggccaccacgccttcagcgactac

SEQ ID NO: 3487 - DNA, 351 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccagggctgcgtcctaaccggcgtctgggtcatagcccacgaatgcggccaccacgccttcagcgactac

SEQ ID NO: 3488 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctttggcctctctactgggcctgccaagggtgcgtcctaaccggcgtctgggtcatagcccacgagtgcggccaccacgccttcagcgactac

SEQ ID NO: 3489 - DNA, 346 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccagggctgcgtcctaaccggcgtctgggtcatagcccacgagtgcggccaccacgccttcagcgactac

SEQ ID NO: 3490 - DNA, 356 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccagggctgtgtcctaaccggcgtctgggtcatagcccacgagtgcggccaccacgccttcagcgactac

SEQ ID NO: 3491 - DNA, 345 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctccctggcctctctactgggcctgccagggctgcgtcctaacgggcctctgggtcatagcccacgagtgcggccaccacgccttcagcgactac

SEQ ID NO: 3492 - DNA, 338 bp, Artificial
  Mutation in BnaA.FAD2.a introduced by TALE nuclease pair BnFAD2_T01
caggatccatgggtgcaggtggaagaatgcaagtgtctcctccctccaaaaagcctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattactgggcctgccagggctgcgtcctaaccggcgtctgggtcatagcccacgagtgcggccaccacgccttcagcgactac

SEQ ID NO: 3493 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcccctctactgggcctgccaaggctgcgtcctaacgggcctctgggtcatcgcccacgaatgcggccaccacgccttcagcgactac

SEQ ID NO: 3494 - DNA, 325 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttggctgcgtcctaaccggcgtctgggtcatagcccacgagtgcggccaccacgccttcagcgactac

SEQ ID NO: 3495 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatacctcgctctttctcctacctcatctgggacatcatcatagcctcctgcttctactacgtcgccaccacttacttccctctcctccctcaccctctctcctactggcctctctactgggcctgccagggctgcgtcctaaccggcgtctgggtcatagcccacgagtgcggccaccacgccttcagcgactac

SEQ ID NO: 3496 - DNA, 423 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgggcccaggcccacggcttgaccccggagcaggtggtggccatcgccagccacgatggcggcaacagccgctggactggcctctctactgggcctgccagggctgcgtcctaaccggcgtctgggtcatagcccacgagtgcggccaccacgccttcagcgactac

SEQ ID NO: 3497 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcttctggcctctctactgggcctgccagggctgcgtcctaaccggcgtctgggtcatagcccacgagtgcggccaccacgccttcagcgactac

SEQ ID NO: 3498 - DNA, 380 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacagtggcccggcgcacgcgctctggaggcctgcctctctactgggcctgccaagggtgcgtcctaacgggcctctgggtcatagcccacgagtgcggccaccacgccttcagcgactac

SEQ ID NO: 3499 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctccccctctctcctacctctctactgggcctgccagggctgcgtcctaaccggcgtctgggtcatagcccacgagtgcggccaccacgccttcagcgactac

SEQ ID NO: 3500 - DNA, 329 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgggcctgccagggctgcgtcctaaccggcgtctgggtcatagcccacgagtgcagccaccacgccttcagcgactac

SEQ ID NO: 3501 - DNA, 351 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccagggctgcgtcctaaccggcgtctgggtcatagcccacgagtgcggccaccacgccttcagcgactac

SEQ ID NO: 3502 - DNA, 348 bp, Artificial
  Mutation in BnaA.FAD2.a introduced by TALE nuclease pair BnFAD2_T01
caggatccatgggtgcaggtggaagaatgcaagtgtctcctcactccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctatcctacttggcctctctactgggcctgccaagggtgcgtcctaaccggcgtctgggtcatagcccacgagtgcggccaccacgccttcagcgactac

SEQ ID NO: 3503 - DNA, 430 bp, Artificial
  Mutation in BnaA.FAD2.a introduced by TALE nuclease pair BnFAD2_T01
caggatccatgggtgcaggtggaagaatgcaagtctatcctcccttcagctcccccggaaccaacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccgtacgtacggccagcagcgtcggttcgagatggcgctcgatgactcccacgatggccaccacctccccctgggtcaagccagctggcctctctactgggcctgccagggctgcgtcctaaccgtcgtctgtgtcatagcccaccagcgcgtccaccacgccttcagcgactac

SEQ ID NO: 3504 - DNA, 429 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgggcgtcctgcccgcccccctccgggccgttgcttcacaccatcgtggctggcgatggccaccacctgctccggggtcatggcctctctactgggcctgccaagggtgcgtcctaaccggcgtctgggtcatagcccacgagtgcggccaccacgccttcagcgactac

SEQ ID NO: 3505 - DNA, 349 bp, Artificial
  Mutation in BnaA.FAD2.a introduced by TALE nuclease pair BnFAD2_T01
caggatccatgggtgcaggtggaagaatgcaagtgtcccctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 3506 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgggcctctctactgggcctgccaagggtgcgtcctaaccggcgtctgggtcatagcccacgagtgcggccaccacgccttcagcgactac

SEQ ID NO: 3507 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggcctctctactgggcctgccaagggtgcgtcctaaccggcgtctgggtcatagcccacgagtgcggccaccacgccttcagcgactac

SEQ ID NO: 3508 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtctggcctctctactgggcctgccagggctgcgtcctaaccggcgtctgggtcatagcccacgagtgcggccaccacgccttcagcgactac

SEQ ID NO: 3509 - DNA, 356 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccagggctgcgtcctaaccggcgtctgggtcatagcccacgagtgcggccaccacgcctgcagcgactac

SEQ ID NO: 3510 - DNA, 356 bp, Artificial
  Mutation in BnaA.FAD2.a introduced by TALE nuclease pair BnFAD2_T01
caggatccatgggtgcaggtgcaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccacgccttcagcgactac

SEQ ID NO: 3511 - DNA, 348 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 3512 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaaccccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccagggctgcgtcctaaccggcgtctgggtcatagcccacgagtgcggccaccacgccttcagcgactac

SEQ ID NO: 3513 - DNA, 349 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaaggctgcgtcctaacgggcctctgggtcatagcccacgagtgcggccaccacgccttcagcgactac

SEQ ID NO: 3514 - DNA, 338 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccctctctactgggcctgccaaggctgcgtcctaacgggcctctgggtcatcgcccacgaatgcggccaccacgccttcagcgactac

SEQ ID NO: 3515 - DNA, 338 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattactgggcctgccagggctgcgtcctaaccggcgtctgggtcatagcccacgagtgcggccaccacgccttcagcgactac

SEQ ID NO: 3516 - DNA, 357 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctccccccgcctggcccctctactgggcctgccaaggctgcgtcctaacgggcctctgggtcatcgcccacgaatgcggccaccacgccttcagcgactac

SEQ ID NO: 3517 - DNA, 323 bp, Artificial
  Mutation in BnaA.FAD2.a introduced by TALE nuclease pair BnFAD2_T01
caggatccatgggtgcagttggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctcgagccacccactgggcctgccaagggtgcgtcctaaccggcgtctgggtcatagcccacgagtgcggccaccacgccttcagcgactac

SEQ ID NO: 3518 - DNA, 387 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgccgccatcgtggctggcgatggccaccacctgcacctggcctctctactgggcctgccaagggtgcgtcctaaccggcggctgggtcatagcccacgagtgcggccaccacgccttcagcgactac

SEQ ID NO: 3519 - DNA, 356 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccttcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccacgccttcagcgactac

SEQ ID NO: 3520 - DNA, 339 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgacacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacttcgccggcctgccagggctgcgtcctgaccggcgtctgggtcatagcttacgagtgcggccaccacgccttcagcgactac

SEQ ID NO: 3521 - DNA, 441 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggtggccatcgccagccacgatggtggcaagcaggcgctggagacggtccagcggctgttgccggtgctgtgccaggcccacggcttgacccctggcctctctactgggcctgccagggctgcgtcctaacgggcctctgggtcatagcccacgagtgcggccaccacgccttcagcgactac

SEQ ID NO: 3522 - DNA, 450 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgaaaacggcttgtcccgcgtcatcggcgggggtcataacgtgcctcccttaaggcagtgcatgcatggcgcaatgcactgacgggtgccccgctcaactttggcctctctactgggcctgccagggctgcgtcctaaccggcgtctgggtcatagcccacgagtgcggccaccacgccttcagcgactac

SEQ ID NO: 3523 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatcccacgctccttctcctacctcatctgggacatcatcatagcctcctgcttctactacgtcgccaccacttacttccctctcctccctcaccctctctcctacggcctctctactgggcctgccagggctgcgtcctaaccggcgtctgggtcatagcccacgaatgcggccaccacgccttcagcgactac

SEQ ID NO: 3524 - DNA, 449 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttcgcccggcccacggcttgaccccccagcaggtggtggccatcgccagcaatggcggtggcaagcaggcgctggagacggtccagcggctgttgccggtgctggcctctctactgggcctgccagggctgcgtcctaaccggcgtctgggtcatagcccacgagtgcggccaccacgccttcagcgactac

SEQ ID NO: 3525 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctccttctcctacctcctcttcgacatcatcatctcctcctcggctcctccctctaccacctctccacagcctacttccctctcctccctcaccctctctcctacttactgggcctgccagggctgcgtcctaaccggcgtctgggtcatagcccacgagtgcggccaccacgccttcagcgactac

SEQ ID NO: 3526 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagcctgaaaccgacaacatcaagcgcgtaccctgcgagacaccgcccttcactgtcggagaactcaagaaagcaatcccacctcactgcttcaaacgctcgctccctcgctctttctcctacctcatctgggacctcatcatagcctcctgcttctactacgtcgccaccacttacttccctctcctccctcaccctctcccctactgggcctgccaagggtgcgtcctaaccggcgtctgggtcatagcccacgagtgcggccaccacgccttcagcgactac

SEQ ID NO: 3527 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttctggcctctctactgggcctgccagggctgcgtcctaaccggcgtctgggtcatagcccacgagtgcggccaccacgccttcagcgactac

SEQ ID NO: 3528 - DNA, 347 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccagggctgcgtcctaaccggcctctgggtcatcgcccacgaatgcggccaccacgccttcagcgactac

SEQ ID NO: 3529 - DNA, 434 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcggctgttgccggtgctgtgccaggcccacggcttgaccccccagcaggtggtggccatcgccagcaatggcggtggcaagcaggcgctggaggcctcgcctctctactgggcctgccagggctgcgtcctaaccggcgtctgggtcatagcccacgagtgcggccaccacgccttcagcgactac

SEQ ID NO: 3530 - DNA, 345 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttccctctactgggcctgccagggctgcgtcctaaccggcgtctgggtcatagcccacgagtgcggccaccacgccttcagcgactac

SEQ ID NO: 3531 - DNA, 348 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 3532 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccagcgtctgggtcatagcccacgagtgcggccaccacgccttcagcgactac

SEQ ID NO: 3533 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgtttcaaacgctcgatccctcgctctttctcctacctcatctgggacatcatcatagcctcctgcttctactacgtcgccaccacttacttccctctcctccctcaccctctctcctacttctctactgggcctgccaagggtgcgtcctaaccggcgtctgggtcatagcccacgagtgcggccaccacgccttcagcgactac

SEQ ID NO: 3534 - DNA, 341 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgggcctgccagggctgcgtcctaaccggcgtctgggtcatagcccacgagtgcggccaccacgccttcagcgactac

SEQ ID NO: 3535 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactaggcctctctactgggcctgccagggctgcgtcctaaccggcgtctgggtcatagcccacgagtgcggccaccacgccttcagcgactac

SEQ ID NO: 3536 - DNA, 350 bp, Artificial
  Mutation in BnaA.FAD2.a introduced by TALE nuclease pair BnFAD2_T01
caggatccatgggtgcaggtggaagaatgcaagtgtctactccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatcgcccacgaatgcggccaccacgccttcagcgactac

SEQ ID NO: 3537 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagcctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctactgggcctgccaaggctgcgtcctaacgggcctctgggtcatagcccacgagtgcggccaccacgccttcagcgactac

SEQ ID NO: 3538 - DNA, 332 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgtgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccagggctgcgtcctaaccggcgtctgggtcatagcccacgagtgcggccaccacgccttcagcgactac

SEQ ID NO: 3539 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcttctctactgggcctgccagggctgcgtcctaaccggcgtctgggtcatagcccacgagtgcggccaccacgccttcagcgactac

SEQ ID NO: 3540 - DNA, 331 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccatcaccctctctccgggcctgccagggctgcgtcctaaccggcgtctgggtcatagcccacgagtgcggccaccacgccttcagcgactac

SEQ ID NO: 3541 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggacaactcaagaaagcaatcccaccgcactgtttcaaacgctcgatccctcgctctttctcctacctcatctgggacatcatcatagcctcctgcttctactacgtcgccaccacttacttccctctcctccctccccctctctcctactacctggcctctctactgggcctgccagggctgcgtcctaaccggcgtctgggtcatagcccacgagtgcggccaccacgccttcagcgactac

SEQ ID NO: 3542 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggccatcatcatagcctcctgcttctactacgtcgccaccacttacttccctctcctccctctccctctctcctccgctggcctctctactgggcctgccagggctgcgtcctaaccggcgtctgggtcatagcccacgagtgcggccaccacgccttcagcgactac

SEQ ID NO: 3543 - DNA, 346 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccagggctgcgtcctaaccggcgtctgggtcatagcccacgagtgcggccaccacgccttcagcgactac

SEQ ID NO: 3544 - DNA, 341 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgggcctgccagggctgcgtcctaaccggcctctgggtcatagcccacgagtgcggccaccacgccttcagcgactac

SEQ ID NO: 3545 - DNA, 450 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgaaaacggcttgtcccgcgtcatcggcgggggtcataacgtgactcccttaaggcagtgcatgcatggcgcaatgcactgacgggtgccccgctcaactttggcctctctactgggcctgccagggctgcgtcctaaccggcgtctgggtcatagcccacgagtgcggccaccacgccttcagcgactac

SEQ ID NO: 3546 - DNA, 356 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccagggctgcgtcctaaccggcgtctgggtcatagcccacgagtgcggccaccacgccttcagccactac

SEQ ID NO: 3547 - DNA, 349 bp, Artificial
  Mutation in BnaA.FAD2.a introduced by TALE nuclease pair BnFAD2_T01
caggatccatggggtgcaggtggaagaatgcaagtctctcctccctccagctcccccgaaaccaaaaccctcaaacgcgtcccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 3548 - DNA, 346 bp, Artificial
  Mutation in BnaA.FAD2.a introduced by TALE nuclease pair BnFAD2_T01
caggatccatgggtgcaggtggaagaatgcaagtatatcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactggtcctgccagggctgcgtcctaaccggcgtctgggtcatagcccacgagttcggccaccacgccttcagcgactac

SEQ ID NO: 3549 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctaaccggcgtctgggtcatagcccacgagtgcggccaccacgccttcagcgactac

SEQ ID NO: 3550 - DNA, 358 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccccccccctctcccttacctcgcctcgtctggcccctctactgggcctgccaaggctgcgtcctaacgggcctctgggtcatcgcccacgaatgcggccaccacgccttcagcgactac

SEQ ID NO: 3551 - DNA, 414 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccggcaaaatcgcgccgaaggatgtcgctgccgactgggcaatggagcgcctgccggcccacctggcctctctactgggcctgccaagggtgcgtcctaaccggcgtctgggtcatagcccacgagtgcggccaccacgccttcagcgactac

SEQ ID NO: 3552 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcaatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 3553 - DNA, 335 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccagggctgcgtcctaaccggcgtctgggtcatagcccacgagtgcggccaccacgccttcagcgactac

SEQ ID NO: 3554 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccaaggctgcgtcctaacgggcctctgggtcatagcccacgagtgcggccaccacgccttcagcgactac

SEQ ID NO: 3555 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgcctgcagcgactac

SEQ ID NO: 3556 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgttccctcgctctttctcctacctcatctgggacatcatcatagcctcctgcttctactacgtcgccaccacttacttccctctcctccctcaccctctctcctacgtctggcctctctactgggcctgccagggctgcgtcctaaccggcgtctgggtcatagcccacgagtgcggccaccacgccttcagcgactac

SEQ ID NO: 3557 - DNA, 332 bp, Artificial
  Mutation in BnaA.FAD2.a introduced by TALE nuclease pair BnFAD2_T01
caggatccattggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccagggctgcgtcctaaccggcgtctgggtcatagcccacgagtgcggccaccacgccttcagcgactac

SEQ ID NO: 3558 - DNA, 334 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctacagggccggccaggactgcgtcctgaccggcgtctgggtcatagcccgcgagtgcggccaccacgccttcagcgactac

SEQ ID NO: 3559 - DNA, 332 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcaatgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccagggctgcgtcctaaccggcgtctgggtcatagcccacgagtgcggccaccacgccttcagcgactac

SEQ ID NO: 3560 - DNA, 334 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccagggctgcgtcctaaccggcgtctgggtcatagcccacgagtgcggcccccacgccttcaggactac

SEQ ID NO: 3561 - DNA, 349 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaacgggcctctgggtcatagcccacgagtgcggccaccacgccttcagcgactac

SEQ ID NO: 3562 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggtcatcatcatagcctcctgcttctactacgtcgccaccacttacttccctctcctccctcaccctctcccttacctctggcccctctactgggcctgccaaggctgcgtcctaacgggcctctgggtcatcgcccacgaatgcggccaccacgccttcagcgactac

SEQ ID NO: 3563 - DNA, 352 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcccgccctggcctctctactgggcctgccagggctgcgtcctaaccggcgtctgggtcatagcccacgagtgcggccaccacgccttcagcgactac

SEQ ID NO: 3564 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgagtcatagcccacgagtgcggccaccacgccttcggcgactac

SEQ ID NO: 3565 - DNA, 343 bp, Artificial
  Mutation in BnaA.FAD2.a introduced by TALE nuclease pair BnFAD2_T01
caggatccatgggtgcaggtggaagaatgcaagtgtaacctacctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccagggctgcgtcctaaccggcgtctgggtcatagcccacgagtgcggccaccacgccttcagcgactac

SEQ ID NO: 3566 - DNA, 332 bp, Artificial
  Mutation in BnaA.FAD2.a introduced by TALE nuclease pair BnFAD2_T01
caggatccatgggtgcaggtggaagaatgcaagtgtctcctccctccaaaaagcctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcatagcccacgagtgcggccaccacgccttcagcgactac

SEQ ID NO: 3567 - DNA, 354 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttccgcctggcctctctactgggcctgccaagggtgcgtcataaccggcgtctgggtcatagcccacgagtgcggccaccacgccttcagcgactac

SEQ ID NO: 3568 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagactgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccctcagcgactac

SEQ ID NO: 3569 - DNA, 398 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctccccccctctcctccttcccttggcaacgctgcgatcctgtcctgatacttgacagcgacggtccctggcctctctactgggcctgccaagggtgcgtcctaaccggcgtctgggtcatagcccacgagtgcggccaccacgccttcagcgactac

SEQ ID NO: 3570 - DNA, 378 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacatcatctgggacatcatcatagcctcctgcttctactacgtcgccaccacttacttccctctcctccctcaccctctctcctacttcgcctccagcgcctgcttgccgccatcgtggctggcgatggccaccacctgctccggggtcaagccgtgagggctgggtcatagcccacgaatgcggccaccacgccttcagcgactac

SEQ ID NO: 3571 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaattccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 3572 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgccttggcctctctactgggcctgccaagggtgcgtcctaaccggcgtctgggtcatagcccacgagtgcggccaccacgccttcagcgactac

SEQ ID NO: 3573 - DNA, 324 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcgccaagggtgcgtcctaaccggcgtctgggtcatagcccacgagtgcggccaccacgccttcagcgactac

SEQ ID NO: 3574 - DNA, 357 bp, Artificial
  Mutation in BnaA.FAD2.a introduced by TALE nuclease pair BnFAD2_T01
caggatccatgggtgcaggtggaagaatgcaagtctctcctgcctccaaaaagtctgaaaccgacaacatcaagcgcgtaccctgcgagccaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcgcccctggcctctctactgggcctgccagggctgcgtcctaaccggcgtctggttcatagcccacgagtgcggccaccacgccttcagcgactac

SEQ ID NO: 3575 - DNA, 345 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccaaggctgcgtcctaacgggcctctgggtcatcgcccacgaatgcggccaccacgccttcagcgactac

SEQ ID NO: 3576 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccagggctgcgtcctaaccggcgtctgggtcatagcccacgagtgcggccaccacgccttcagcgactac

SEQ ID NO: 3577 - DNA, 357 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtccccaccacttacttccctctcctccctcaccctctctcttcctccgcccgcctggcctctctactgggcctgccagggctgcgtcctaaccggcgtctgggtcatagcccacgagtgcggccaccacgccttcagcgactac

SEQ ID NO: 3578 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctttcctggcctctctactgggcctgccagggctgcgtcctaaccggcgtctgggtcatagcccacgagtgcggccaccacgcctgcagcgactac

SEQ ID NO: 3579 - DNA, 312 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccacctcactgcttcaaacgctccatcccacgctccttctcctcttcgacatcatcatctcctcctcggctcctccctcaccctctctcctacttcgcctctctactgggcctgccagggctgcgtcctaaccggcgtctgggtcatagcccacgagtgcggccaccacgccttcagcgactac

SEQ ID NO: 3580 - DNA, 380 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctagatccctcgctctttctcctacctcatctgggacatcatcatagcctcctgcttctactacgtcgccaccacttacttccctctcctccctcaccctctctcctaactgagcctttcgttttatctgttgtttgtcggtggcctctctactgggcctgccaagggtgcgtcctaaccggcgtctgggtcatagcccacgagtgcggccaccacgccttcagcgacctac

SEQ ID NO: 3581 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaaggctgcgtcctaacgggcctctgggtcatagcccacgagtgcggccaccacgccttcagcgactac

SEQ ID NO: 3582 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctgcctctctactgggcctgccagggctgcgtcctaaccggcgtctgggtcatagcccacgagtgcggccaccacgccttagcgactac

SEQ ID NO: 3583 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgtgacatcatcatagcctcctgcttctactacgtcgccaccacttacttccctctcctccctcaccctctctcctacttcggcctctctactgggcctgccaagggtgcgtcctaaccggcgtcttggtcatagcccacgagtgcggccaccacgccttcagcgactac

SEQ ID NO: 3584 - DNA, 450 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgaaaacggcttgtcccgcgtcatcggcgggggtcataacgtgactcccttaaggcagtgcatgcatggcgcaatgcactgacgggtgccccgctcaactttggcctctctactgggcctgccagggctgcgtcctaaccggcgtctgggtcatagcccacgagtgcggccaccacgccttcagcgactac

SEQ ID NO: 3585 - DNA, 340 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgttgccaccacttacttccctctcctccctcaccctctctcctactttacggggcctgccagtgctgcgtcctaaccggcgtctgggtcatagcccacgagtgcggccaccacgccttcagcgactac

SEQ ID NO: 3586 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctactccgctggcctctctactgggcctgccagggctgcgtcctaacgggcctctgggtcatcgcccacgaatgcggccaccacgccttcagcgactac

SEQ ID NO: 3587 - DNA, 439 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggtccagcgcctgcttgccgccatcgtggctggcgatggccaccacctgctccggggtcaagccgtgggcctggcacagcaccggcaagcaggcgctgtctctactgggcctgccagggctgcgtcctaaccggcgtctgggtcatagcccacgagtgcggccaccacgccttcagcgactac

SEQ ID NO: 3588 - DNA, 345 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctaggcctctctactgggcctgccagggctgcgtcctaaccggcgtctgggtcatagcccacgagtgcggccaccacgccttcagcgactac

SEQ ID NO: 3589 - DNA, 356 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccagggctgcgtcctaaccggcgtctgggtcatagcccacgagtgcggccaccacgccttcagcgactac

SEQ ID NO: 3590 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccgccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccagggctgcgtcctaaccggcgtctgggtcatagcccacgagtgcggccaccacgccttcagcgactac

SEQ ID NO: 3591 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgagtcatagcccacgagtgcggccaccacgccttcagcgactac

SEQ ID NO: 3592 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttaactgtaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 3593 - DNA, 335 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcctctctactgggcctgccagggctgcgtcctaacgggcctctgggtcatcgcccacgaatgcggccaccacgccttcagcgactac

SEQ ID NO: 3594 - DNA, 347 bp, Artificial
  Mutation in BnaA.FAD2.a introduced by TALE nuclease pair BnFAD2_T01
caggaccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 3595 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccagggctgcgtcctaaccggcgtctgggtcatagcccacgagtgcggccaccacgcctgcagcgactac

SEQ ID NO: 3596 - DNA, 357 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccgcctggcctctctactgggcctgccggggctgcgtcctaaccggcgtctgggtcatagcccacgagtgcggccaccacgccttcagcgactac

SEQ ID NO: 3597 - DNA, 349 bp, Artificial
  Mutation in BnaA.FAD2.a introduced by TALE nuclease pair BnFAD2_T01
caggatccatgggtgcaggtggaagaatgcaagtgtctcctccctccagaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcaccaccacttacttccctctcctccctcaccctctctcctcctttggcctctctactgggcctgccaagggtgcgtcctaaccggcgtctgggtcatagcccacgagtgcggccaccacgccttcagcgactac

SEQ ID NO: 3598 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccatcgctctttctcctacctcatctgggacatcatcatagcctcctgcttctactacgtcgccaccacttacttccctctcctccctcaccctctctcctatggcctctctactgggcctgccagggctgcgtcctaaccggcctctgggtcatagcccacgagtgcggccaccacgccttcagcgactac

SEQ ID NO: 3599 - DNA, 351 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcgcggcctctctactgggcctgccagggctgcgtcctaaccggcgtctgggtcatagcccacgagtgcggccaccacgccttcagcgactac

SEQ ID NO: 3600 - DNA, 338 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctccatcccacgctccttctcctcttcgacatcatcatctcctcctcggctcctccctctaccacctctccacagcctacttccctctcctcccccaccctctcccctctactgggcctgccagggctgcgtcctaaccggcgtctgggtcatagcccacgagtgcggccaccacgccttcagcgactac

SEQ ID NO: 3601 - DNA, 343 bp, Artificial
  Mutation in BnaA.FAD2.a introduced by TALE nuclease pair BnFAD2_T01
caggatccatgggtgcaggtggaagaatgcaagtgtctcgtccctccaagaagactgaaacggacacaataaagcgcgaaaaatgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctcctgggcctgccagggctgcgtcctaaccggcgtctgggtcatagcccaccactgcggccaccacgccttcagcgactac

SEQ ID NO: 3602 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgggcctgccagggctgcgtcctaaccggcgtctgggtcatagcccacgagtgcggccaccacgccttcagcgactac

SEQ ID NO: 3603 - DNA, 337 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctactgggcctgccaagggtgcgtcctaaccggcgtctgggtcatagcccacgagtgcggccaccacgccttcagcgactac

SEQ ID NO: 3604 - DNA, 349 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 3605 - DNA, 374 bp, Artificial
  Mutation in BnaA.FAD2.a introduced by TALE nuclease pair BnFAD2_T01
cagcatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctttgatccggttcctgaacaggatctatttgatggcctctctactgggcctgccaagggtgcgtcctaaccggcgtctgggtcatagcccacgagtgcggccaccacgccttcagcgactac

SEQ ID NO: 3606 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagcctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccagggctgcgtcctaaccggcgtctgggtcatagcccacgagtgcggccaccacgccttcagcgactac

SEQ ID NO: 3607 - DNA, 349 bp, Artificial
  Mutation in BnaA.FAD2.a introduced by TALE nuclease pair BnFAD2_T01
caggatccatgggtgcaggtggaagaatgcaagcgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaaccggcgtctgggtcatagcccacgagggcgtccaccacgcctgcagccactac

SEQ ID NO: 3608 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccaaccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 3609 - DNA, 338 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctattactgggcctgccagggctgcgtcctaaccggcgtctgggtcatagcccacgagtgcggccaccacgccttcagcgactac

SEQ ID NO: 3610 - DNA, 348 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 3611 - DNA, 347 bp, Artificial
  Mutation in BnaA.FAD2.a introduced by TALE nuclease pair BnFAD2_T01
caggatccatgggtgcaggtgcaagaatgcaagtctctcctccctccagctcccccggaaccaacaccctcaaacgcgtcccctgcgagacaccaccattcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctaatggcctctctactgggcctgccagggctgcgtcctaaccggcgtctgggtcatagcccacgagtgcggccaccacgcctgcagcgactac

SEQ ID NO: 3612 - DNA, 348 bp, Artificial
  Mutation in BnaA.FAD2.a introduced by TALE nuclease pair BnFAD2_T01
caggatccatgggtgcaggtggaagaatgcaagtgtatcctccctcccaaaagcctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctagccggggtctgggtggtagcccacgagtgcggccaccacgccttcagcgactac

SEQ ID NO: 3613 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggactgccaagggtacgtcctaaccggcgtcggggtcatatcccacgagtgcggccaccacaccatcagcaactac

SEQ ID NO: 3614 - DNA, 339 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttactgggcctgccagggctgcgtcctaaccggcgtctgggtcatagcccactagtgcggccaccacgccttcagcgactac

SEQ ID NO: 3615 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattggcctctctactgggcctgccaagggtgcgtcctaaccggcgtctgggtcatagcccacgagtgcggccaccacgccttcagcgactac

SEQ ID NO: 3616 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagtccacgagtgcggccaccacgccttcagcgactac

SEQ ID NO: 3617 - DNA, 349 bp, Artificial
  Mutation in BnaA.FAD2.a introduced by TALE nuclease pair BnFAD2_T01
caggatccatgggtgcaggtggaagaatgcaagtgtctcctccatccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 3618 - DNA, 350 bp, Artificial
  Mutation in BnaA.FAD2.a introduced by TALE nuclease pair BnFAD2_T01
gcaggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 3619 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcgaccaccacgccttcagcgactac

SEQ ID NO: 3620 - DNA, 336 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccaagggtgcgtcctaaccggcctctgggtcatcgcccacgaatgcggccaccacgccttcagcgactacc

SEQ ID NO: 3621 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaacgggcctctgggtcatagcccacgagtgcggccaccacgccttcagcgactac

SEQ ID NO: 3622 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctccccctctctcctccgcctggcctctctactgggcctgccagggctgcgtcctaaccggcgtctgggtcatagcccacgagtgcggccaccacgccttcagcgactac

SEQ ID NO: 3623 - DNA, 332 bp, Artificial
  Mutation in BnaA.FAD2.a introduced by TALE nuclease pair BnFAD2_T01
caggatccatgggtgcaggtggaggaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcatagcccacgagtgcggccaccacgccttcagcgactac

SEQ ID NO: 3624 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatcctctctactgggcctgccagggctgcgtcctaaccggcgtctgggtcatagcccacgagtgcggccaccacgccttcagcgactac

SEQ ID NO: 3625 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccagggctgcgtcctaacgggcctctgggtcatagcccacgagtgcggccaccacgccttcagcgactac

SEQ ID NO: 3626 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggccttccagggctgcgtcctaaccggcgtctgggtcatagcccacgagtgcggccaccacgccttcagcgactac

SEQ ID NO: 3627 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccagggctgcgtcctaacgggcctctgggtcatagcccacgagtgcggccaccacgccttcagcgactac

SEQ ID NO: 3628 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctaaccggcgtctgggtcatagcccacgagtgcggccaccacgccttcagcgactac

SEQ ID NO: 3629 - DNA, 334 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaacctacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccagggctgcgtcctaaccggcgtctgggtcatagcccacgagtgcggccaccacgccttcagcgactac

SEQ ID NO: 3630 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcatccctcaccctctctccaactctggccgctctactgggcctgccaagggtgcgtcctaaccggcgtctgggtcatagcccacgagtgcggccaccacgcttcagcgactac

SEQ ID NO: 3631 - DNA, 345 bp, Artificial
  Mutation in BnaA.FAD2.a introduced by TALE nuclease pair BnFAD2_T01
caggatccatgggtgcaggtggaagaatgcgagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctccttctctctactgggcccgccaagggtgcgtcctaaccggcgtcggggtcatagcccacgagtgcggccaccacgccttcagcgactac

SEQ ID NO: 3632 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttctctactgggcctgccagggctgcttcctaacgggcctctgggtcatagcccacgagtgcggccaccacgccttcagcgactac

SEQ ID NO: 3633 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccatggctgcgtcctaaccggcgtctgggtcatagcccacgagtgcggccaccacgccttcagcgacta

SEQ ID NO: 3634 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttgccttggcccctctactgggcctgccaaggctgcgtcctaacgggcctctgggtcatcgcccacgaatgcggccaccacgccttcagcgactac

SEQ ID NO: 3635 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagccccctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 3636 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaaaaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 3637 - DNA, 346 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccaacggcctctctactgggcctgccagggctgcgtcctaaccggcgtctgggtcatagcccacgagtgcggccaccacgccttcagcgactac

SEQ ID NO: 3638 - DNA, 347 bp, Artificial
  Mutation in BnaA.FAD2.a introduced by TALE nuclease pair BnFAD2_T01
caggatccatgggtgcaggtggaagaatgcaagtgtctcctccctacaaaaagtctgaaaccgacaacatcaagcgcgtaccctgcgagacaccgcccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctattggcctctctactgggcctgccaagggtgcgtcctaaccggcgtctgggtcatagcccacgagtgcggccaccacgccttcagcgactac

SEQ ID NO: 3639 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctagatccctcgctctttctcctacctcatctgggacatcatcatagcctcctgcttctactacgtcgccaccacttacttccctctcctccctcaccctctctcctacttcgcccctggcctctctactgggcctgccaagggtgcgtcctaaccggcgtctgggtcatagcccacgagtgcggccaccacgccttcagcgactac

SEQ ID NO: 3640 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccagggctgcgtcctaaccggcgtctgggtcatagcccacgagtgcggccaccacgccttcagcgactac

SEQ ID NO: 3641 - DNA, 450 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgaaaccggcttgtcccgcgtcatcggcgggggtcataacgtgactcccttaaggcagtgcatgcatggcgcaatgcactgacgggtgccccgctcaactttggcctctctactgggcctgccagggctgcgtcctaaccggcgtctgggtcatagcccacgagtgcggccaccacgccttcagcgactac

SEQ ID NO: 3642 - DNA, 332 bp, Artificial
  Mutation in BnaA.FAD2.a introduced by TALE nuclease pair BnFAD2_T01
caggatccatgggtgcaggtcgaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcatagcccacgagtgcggccaccacgccttcagcgactac

SEQ ID NO: 3643 - DNA, 339 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaaacaatcccaccgcactgtttcaaacgctcgatccctcgctctttctcctacctcatctgggacatcatcatagcctcctgcttctactacgtcgccaccacttacttccctctcctccctcaccctctctcctctctactgggcctgccagggctgcgtcctaaccggcgtctgggtcatagcccacgagtgcggccaccacgccttcagcgactac

SEQ ID NO: 3644 - DNA, 424 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttctccaccgcctgcttcccgccatcgtggctggcgctggccaccacctgctccggggtcaagccgtgggcctggcatggcctctctactgggcctgccagggctgcgtcctaaccggcgtctgggtcatagcccacgagtgcggccaccacgccttcagcgactac

SEQ ID NO: 3645 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccccgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggccgctctacggggcctgccaagggtgcgtcgtagccggcgtctggggcataggcgacgagtgcggccaccacgccttcagcgactac

SEQ ID NO: 3646 - DNA, 358 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcgggtctgacctctctactaggcctgccagggctgcgtcctaaccggcgtctgggtcatagcccacgagtgcggccaccacgccttcagcgactac

SEQ ID NO: 3647 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctggcctctctactgggcctgccagggctgcgtcctaaccggcgtctgggtcatagcccacgagtgcggccaccacgccttcagcgactac

SEQ ID NO: 3648 - DNA, 335 bp, Artificial
  Mutation in BnaA.FAD2.a introduced by TALE nuclease pair BnFAD2_T01
catgatccatgggtgcaggtggaagaatgcaagtgtctcctccctcccaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccagggctgcgtcctaaccggcgtctgggtcatagcccacgagtgcggccaccacgccttcagcgactac

SEQ ID NO: 3649 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcgtacctcatctgggacatcatcatagcctcctgcttctactacgtcgccaccacttacttccctctcctccctcaccctctctcctacttcctctctactgggcctgccaagggtgcgtcctaaccggcgtctgggtcatagcccacgagtgcggccaccacgccttcagcgactac

SEQ ID NO: 3650 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcactcctacggcctctctactgggcctgccagggctgcgtcctaacgggcctctgggtcatcgcccacgaatgcggccaccacgccttcagcgactac

SEQ ID NO: 3651 - DNA, 345 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggcctgccagggctgcgtcctaaccggcgtctgggtcatagcccacgagtgcggccaccacgccttcagcgactac

SEQ ID NO: 3652 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccagggctgcgtcctaaccggcgtctgggtcatagcccacgagtgcggccaccacgccttcagcgactac

SEQ ID NO: 3653 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcatccctcaccctctcgcctggcctctctactgggcctgccaagggtgcgtcctaaccggcgtctgggtcatagcccacgagtgcggccaccacgccttcagcgactac

SEQ ID NO: 3654 - DNA, 341 bp, Artificial
  Mutation in BnaA.FAD2.a introduced by TALE nuclease pair BnFAD2_T01
caggatccatgggtgcaggtggaagaatacaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgggcctgccagggctgcgtcctaaccggcgtctgggtcatagcccacgagtgcggccaccacgccttcagcgactac

SEQ ID NO: 3655 - DNA, 334 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccaaggctgcgtcctaacgggcctctcggtcatcgcccacgaatgcggccaccacgccttcagcgactac

SEQ ID NO: 3656 - DNA, 339 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacttactgggcctgccagggctgcgtcctaaccggcgtctgggtcatagcccacgagtgcggccaccacgccttcagcgactac

SEQ ID NO: 3657 - DNA, 349 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctttcctggcctctctactgggcctgccagggctgcgtcctaaccggcgtctgggtcatagcccacgagtgcggccaccacgccttcagcgactac

SEQ ID NO: 3658 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaatggcctctctactgggcctgccaagggtgcgtcctaaccggcgtctgggtcatagcccacgagtgcggccaccacgccttcagcgactac

SEQ ID NO: 3659 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcatccctcaccctctctcctactgctggcctctctactgggcctgccagggctgcgtcctaaccggcgtctgggtcatagcccacgagtgcggccaccacgccttcagcgactac

SEQ ID NO: 3660 - DNA, 341 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttttactgggcctgccagggctgcgtcctaaccggcgtctgggtcatagcccacgagtgcggccaccacgccttcagcgactac

SEQ ID NO: 3661 - DNA, 339 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatcccacgctccttctcctcttcgacatcatcatcacctcctcggctcctccctctaccacctctccacagcctacttccctctcctccctcaccctctctcctattactgggcctgccagggctgcgtcctaaccggcgtctgggtcatagcccacgagtgcggccaccacgccttcagcgactac

SEQ ID NO: 3662 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcgcacgagtgcggccaccacgccttcagcgactac

SEQ ID NO: 3663 - DNA, 345 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccatcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctccctggcctctctactgggcctgccagggctgcgtcctaaccggcgtctgggtcatagcccacgagtgcggccaccacgccttcagcgactac

SEQ ID NO: 3664 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctggggcatcatcatagcctcctgcttctactacgtcgccaccacttacttccctctcctccctcaccctctctcctacatcgccctctctactgggcctgccagggctgcgtcctaaccggcgtctgggtcatagcccacgagtgcggccaccacgccttcagcgactac

SEQ ID NO: 3665 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcctctctactgggcctgccagggctgcgtcctaaccggcgtctgggtcatagcccacgagtgcggccaccacgccttcagcgactac

SEQ ID NO: 3666 - DNA, 323 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctcgagccacccactgggcctgccaagggtgcgtcctaaccggcgtctgggtcatagcccacgagtgcggccaccacgccttcagcgactac

SEQ ID NO: 3667 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttcactctcctccctcaccctctctcctacttggcctctctactgggcctgccagggctgcgtcctaaccggcctctgggtcatcgcccacgaatgcggccaccacgccttcagcgactac

SEQ ID NO: 3668 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcacgtaccctgcgagacaccgcccttcaatgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacctgtgcggccaccacgccttccgcgcctcc

SEQ ID NO: 3669 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctactgggcctgccagggctgcgtcctaaccggcgtctgggtcatagcccacgagtgcggccaccacgccttcagcgactac

SEQ ID NO: 3670 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctactgcttctactacgtcgccaccacttacttccctctcctccctcaccctctctcctcctttggcctctctactgggcctgccagggctgcgtcctaaccggcgtctgggtcatagcccacgagtgcggccaccacgccttcagcgactac

SEQ ID NO: 3671 - DNA, 352 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccgccctggcctctctactgggcctgccagggctgcgtcctaaccggcgtctgggtcatagcccacgagtgcggccaccacgccttcagcgactac

SEQ ID NO: 3672 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttcttctacgtcgccaccacttacttccctctcctccctcaccctctctcctactcgcctctctactgggcctgccagggctgcgtcctaaccggcgtctgggtcatagcccacgagtgcggccaccacgccttcagcgactac

SEQ ID NO: 3673 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctttcctggcctctctactgggcctgccagggctgcgtcctaaccggcgtctgggtcatagcccacgagtgcggccaccacgccttcagcgactac

SEQ ID NO: 3674 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctggcccctctactgggcctgccaaggctgcgtcctaacgggcctctgggtcatcgcccacgaatgcggccaccacgccttcagcgactac

SEQ ID NO: 3675 - DNA, 414 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttcgccggcaaaatcgcgccgaaggatgtcgctgccgactgggcaatggagcgcctgccggcccacctggcctctctactgggcctgccaagggtgcgtcctaaccggcgtctgggtcatagcccacgagtgcggccaccacgccttcagcgactac

SEQ ID NO: 3676 - DNA, 341 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacctctactgggcctgccagggctgcgtcctaaccggcgtctgggtcatagcccacgagtgcggccaccacgccttcagcgactac

SEQ ID NO: 3677 - DNA, 340 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttactgggcctgccagggctgcgtcctaaccggcgtctgggtcatagcccacgagtgcggccaccacgccttcacgactac

SEQ ID NO: 3678 - DNA, 349 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccagggctgcgtcctaaccggcgtctgggtcatagcccacgagtgcggccaccacgccttcagcgactac

SEQ ID NO: 3679 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatcccacgctccttctcctcttcgacatcatcatctcctcctcggctcctccctctaccacctctccacagcctacttccctctcctccctcaccctctctcctggcctctctactgggcctgccagggctgcgtcctaaccggcgtctgggtcatagcccacgagtgcggccaccacgccttcagcgactac

SEQ ID NO: 3680 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttatggcctctctactgggcctgccagggctgcgtcctaaccggcgtctgggtcatagcccacgagtgcggccaccacgccttcagcgactac

SEQ ID NO: 3681 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatcgcccacgaatgcggccaccacgccttcagcgactac

SEQ ID NO: 3682 - DNA, 404 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcttgccgccatcgtggctggcgaaggccaccacctgctccggggtcaagccgtgggcctctctactgggcctgccaagggtgcgtcctaaccggcgtctgggtcatagcccacgagtgcggccaccacgccttcagcgactac

SEQ ID NO: 3683 - DNA, 296 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggagacgatggccaccacgccttcagcgactac

SEQ ID NO: 3684 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccaagggtgcgtcctaaccggcgtctgggtcatagcccacgagtgcggccaccacgccttcagcgactac

SEQ ID NO: 3685 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgttggcctctctactgggcctgccagggctgcgtcctaaccggcgtctgggtcatagcccacgagtgcggccaccacgccttcagcgactac

SEQ ID NO: 3686 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaaggctgcgtcctaacgggcctctgggtcatagcccacgagtgcggccaccacgccttcagcgactac

SEQ ID NO: 3687 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctacgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 3688 - DNA, 357 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccggtttgcgtattgccggtgcctggcctctctactgggcctgccaagggtgcgtcctaaccggcgtctgggtcatagcccacgagtgcggccaccacgccttcagcgactac

SEQ ID NO: 3689 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccagggctgcgtcctaaccggcgtcggggtcatagcccacgagtgcggccaccacgccttcagcgactac

SEQ ID NO: 3690 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaaggctgcgtcctaacgggcctctgggtcatagcccacgagtgcggccaccacgccttcagcgactac

SEQ ID NO: 3691 - DNA, 354 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctcccctccctcaccctctctcctacttccgcctggcctctctactgggcctgccagggctgcgtcctaaccggcgtctgggtcatagcccacgagtgcggccaccacgccttcagcgactac

SEQ ID NO: 3692 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctatcctacttgcctctctactgggcctgccaagggtgcgtcctaaccggcgtctgggtcatagcccacgagtgcggccaccacgccttcagcgactac

SEQ ID NO: 3693 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgcctctctactgggcctgccagggctgcgtcctaaccggcgtctgggtcatagcccacgagtgcggccaccacgccttcagcgactac

SEQ ID NO: 3694 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacaggcctctctactgggcctgccagggctgcgtcctaaccggcgtctgggtcatagcccacgagtgcggccaccacgccttcgcgactac

SEQ ID NO: 3695 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcggaccctgcgagacaccgcccttcactgtcagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcttcgcccctggcctctctactgggcctgccaagggtgcgtcctaaccggcgtctgggtcatagcccacgagtgcggccaccacgccttcagcgactac

SEQ ID NO: 3696 - DNA, 455 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctccgctggaccgtctccagcgcctgctggccgccatcgtggctggcgatggccaccacctgctccggggtcaagccgtgggcctggcacagcaccggcaacagccgcttggcctctctactgggcctgccaggactgcgtcctaaccggcgtctgggtcatagcccacgagtgcggccaccacgccttcagcgactac

SEQ ID NO: 3697 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcccttggcctctctactgggcctgccagggctgcgtcctaaccggcgtctgggtcatagcccacgagtgcggccaccacgccttcagcgactac

SEQ ID NO: 3698 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacctctctactgggcctgccagggctgcgtcctaacgggcctctgggtcatcgcccacgaatgcggccaccacgccttcagcgactac

SEQ ID NO: 3699 - DNA, 345 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccagggctgcgtcctaaccggcgtctgggtcatagcccacgagtgcggccaccacgccttcagcgactac

SEQ ID NO: 3700 - DNA, 332 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccagggctgcgtcctaaccggcgtctgggtcatagcccacgagtgcggccaccacgccttcagcgactac

SEQ ID NO: 3701 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccaagagtgcggccaccacgccttcagcgactac

SEQ ID NO: 3702 - DNA, 338 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcaccaccacttacttccctctcctccctcaccctctctctctctactgggcctgccaagggtgcgtcctaaccggcgtctgggtcatagcccacgagtgcggccaccacgccttcagcgactac

SEQ ID NO: 3703 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgggcctctctactgggcctgccagggctgcgtcctaaccggcgtctgggtcatagcccacgagtgcggccaccacgccttcagcgactac

SEQ ID NO: 3704 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcccccctcaccctctctcctacttcctctctactgggcctgccagggctgcgtcctaacgggcctctgggtcatagcccacgagtgcggccaccacgccttcagcgactac

SEQ ID NO: 3705 - DNA, 324 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcgccaagggtgcgtcctaaccggcgtctgggtcatagcccacgagtgcggccaccacgccttcagcgactac

SEQ ID NO: 3706 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtcttggtcatagcccacgagtgcggccaccacgccttcagcgactac

SEQ ID NO: 3707 - DNA, 344 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccagggctgcgtcctaaccggcgtctgggtcatagcccacgagtccggccaccacgccttcagcgactac

SEQ ID NO: 3708 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccgcgagtgcggccaccacgccttcagcgactac

SEQ ID NO: 3709 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgctccctcgctctttctcctacctcatctgggacatcatcatagcctcctgcttctactacgtcgccaccacttacttccctctcctccctcaccctctctcctgctttggcctctctactgggcctgccaagggtgcgtcctagcgggcctctgggtcatcgcccacgaatgcggccaccacgccttcagcgactac

SEQ ID NO: 3710 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaacgggcctctgggtcatcgcccacgagtgcggccaccacgccttcagcgactac

SEQ ID NO: 3711 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccagggctgcgtcctaacgggcctctgggtcatagcccacgagtgcggccaccacgccttcagcgactac

SEQ ID NO: 3712 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcgcctggcctctctactgggcctgccagggctgcgtcctaaccggcgtctgggtcatagcccacgagtgcgcccaccacgccttcagcgactac

SEQ ID NO: 3713 - DNA, 332 bp, Artificial
  Mutation in BnaA.FAD2.a introduced by TALE nuclease pair BnFAD2_T01
caggatccatgggtgcaggtggaagaatgcaagtgtctcctcactccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccagggctgcgtcctaaccggcgtctgggtcatagcccacgagtgcggccaccacgccttcagcgactac

SEQ ID NO: 3714 - DNA, 349 bp, Artificial
  Mutation in BnaA.FAD2.a introduced by TALE nuclease pair BnFAD2_T01
caggatccatgggtgcaggtagaagaatgcaagtctctcctcccctccgctcccccgaaaccaaaaccctcaaccgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacgctggcctctctactgggcctgccagggctgcgtcctaaccggcgtctgggtcatagcgcacgagtgcggccaccacgccttcagcgactac

SEQ ID NO: 3715 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgtggcctctctactgggcctgccagggctgcgtcctaaccggcgtctgggtcatagcccacgagtgcggccaccacgccttcagcgactac

SEQ ID NO: 3716 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaaggctgcgtcctaacgggcctctgggtcatcgcccacgaatgcggccaccacgccttcagcgactac

SEQ ID NO: 3717 - DNA, 329 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgggcctgccaaggctgcgtcctaacgggcctctgggtcatagcccacgagtgcggccaccacgccttcagcgactac

SEQ ID NO: 3718 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 3719 - DNA, 348 bp, Artificial
  Mutation in BnaA.FAD2.a introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 3720 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttccggcctctctactgggcctgccagggctgcgtcctaaccggcgtctgggtcatagcccacgagtgcggccaccacgcattcagcgactac

SEQ ID NO: 3721 - DNA, 348 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 3722 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctgctgggcctgccaagggtgcgtcctaaccggcgtctgggtcatagcccacgagtgcggccaccacgccttcagcgactac

SEQ ID NO: 3723 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctgcctctctactgggccggccaagggtgcgtcctaaccggcgtctgggtcatagcccacgagtgcggccaccacgccttcagcgactac

SEQ ID NO: 3724 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccctggcctctctactgggcctgccagggctgcgtcctaaccggcgtctgggtcatcgcccacgaatgcggccaccacgccttcagcgactac

SEQ ID NO: 3725 - DNA, 341 bp, Artificial
  Mutation in BnaA.FAD2.a introduced by TALE nuclease pair BnFAD2_T01
caggatccatgggtgcaggtggaagaatgcaagtgtatcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcatcctctctggcctctctactgggcctgccaagggggcgtccgaacaggcctcggggtcatagcccacgagtgcggccaccacgccttcagcgactac

SEQ ID NO: 3726 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctatcctctctactgggcctgccagggctgcgtcctaaccggcgtctgggtcatagcccacgagtgcggccaccacgccttcagcgactac

SEQ ID NO: 3727 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctcctctctactgggcctgccaagggtgcgtcctaaccggcgtcggggtcatagcccacgagtgcggccaccacgccttcagcgactac

SEQ ID NO: 3728 - DNA, 337 bp, Artificial
  Mutation in BnaA.FAD2.a introduced by TALE nuclease pair BnFAD2_T01
caggatccagggtgcaggtggaagaatgcaagtgtctcctccctccaaaaagtctgaaaccgacaacatcaagcgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactactgggcctgccaagggtgcgtcctaaccggcgtctgggtcatagcccacgagtgcggccaccacgccttcagcgactac

SEQ ID NO: 3729 - DNA, 346 bp, Artificial
  Mutation in BnaA.FAD2.a introduced by TALE nuclease pair BnFAD2_T01
caggatccatgggtgcaggtggaagaatgtaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcctctctactgggcctgccagggctgcgtcctcaccggcgtctgggtcatagcccacgagtgcggccaccacgccttcagcgactac

SEQ ID NO: 3730 - DNA, 386 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccacctcactgtttcaaacgctcgatccctcgctctttctcctacctcatctgggacatcatcatagcctcctgcttctactacgtcgccaccacttacttccctctcctccctcaccctctctcctacttggccaccacctgctggggggtcaagccgtgggcctggcacagtctctactgggcctgccagggctgcgtcctaaccggcgtctgggtcatagcccacgagtgcggccaccacgccttcagcgactac

SEQ ID NO: 3731 - DNA, 352 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtgccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggcctctctactgggcctgccagggctgcgtcctaaccggcgtctgggtcatagcccacgagtgcggccaccacgccttcagcgactac

SEQ ID NO: 3732 - DNA, 393 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccactgggcctttcgttttatctgttgtttgtcggtgaacgctctccttggcctctctactgggcctgccaaggctgcgtcctaacgggcctctgggtcatagcacacgagtgcggccaccacgccttcagcgactac

SEQ ID NO: 3733 - DNA, 346 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacggcctctctactgggcctgccagggctgagtccgaaccggcgtcggggtcatagcccacgagtgcggccaccacgccatcagcgactac

SEQ ID NO: 3734 - DNA, 343 bp, Artificial
  Mutation in BnaA.FAD2.a introduced by TALE nuclease pair BnFAD2_T01
caggatccatggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatcctctctactgggcctgccagggctgcgtcctaaccggcgtctgggtcatagcccacgagtgcggccaccacgccttcagcgactac

SEQ ID NO: 3735 - DNA, 325 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggctgcgtcctaaccggcgtctgggtcatagcccacgagtgcggccaccacgccttcagcgactac

SEQ ID NO: 3736 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctacgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccaagggtgcgtcctaaccggcgtctgggtcatagcccacgagtgcggccaccacgccttcagcgactac

SEQ ID NO: 3737 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctcgatccctcgctctttctcctacctcatctgggacatcatcatagcctcctgcttctactacgtcgccaccacttacttccctctcctccctcaccctctctcctctctctactgggcctgccaagggtgcgtcctaaccggcgtctgggtcatagcccacgagtgcggccaccacgccttcagcgactac

SEQ ID NO: 3738 - DNA, 331 bp, Artificial
  Mutation in BnaA.FAD2.a introduced by TALE nuclease pair BnFAD2_T01
caggatccatgggtgcaggtggaagaatgcaagtgtctcctccatacaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgggcctgccagggctgcgtcctaaccggcgtctgggtcatatcccacgagtgcggccaccacgccttcaacgactac

SEQ ID NO: 3739 - DNA, 344 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctagcctctctactgggcctgccagggctgcgtcctaaccggcgtctgggtcatagcccacgagtgcggccaccacgccttcagcgactac

SEQ ID NO: 3740 - DNA, 390 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttgctggcggtggcaagcacctgctggggggtcaagccgtgggcggcctctctactgggcctgccagggctgcgtcctaaccggcgtctgggtcatagcccacgagtgcggccaccacgccttcagcgactac

SEQ ID NO: 3741 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctactgggcctgccagggctgcgtcctaaccgtcgtctgggtcatagcccacgagtgcggccaccacgccttcagcgactac

SEQ ID NO: 3742 - DNA, 424 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttctccagcgcctgcttgccgccatcgtggctggcgatggccaccacctgctccggggtcaagccgtgggcctggcatggcctctctactgggcctgccaagggtgcgtcctaaccggcgtctgggtcatagcccacgagtgcggccaccacgccttcagcgactac

SEQ ID NO: 3743 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttactttcctctcctccctcaccctctctcccgcctggcctctctactgggcctgccaagggtgcgtcctaaccggcgtctgggtcatagcccacgagtgcggccaccacgccttcagcgactac

SEQ ID NO: 3744 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacccgcctctctactgggcctgccagggctgcgtcctaaccggcgtctgggtcatagcccacgagtgcggccaccacgccttcagcgactac

SEQ ID NO: 3745 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttactgggcctgccagggctgcgtcctaaccggcgtctgggtcatagcccgcgagtgcggccaccacgccttcagcgactac

SEQ ID NO: 3746 - DNA, 342 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcgcctggcctctctactggtcctgccaagggtgcgtcctaaccggcgtctgggtcatagcccacgagtgcggccaccacgccttcagcgactac

SEQ ID NO: 3747 - DNA, 338 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatcccacgctccttctcctacctcatctgggacatcatcatagcctcctgcttctactacgtcgccaccacttacttccctctcctccctcaccctctccctctctactgggcctgccaagggtgcgtcctaaccggcgtctgggtcatagcccacgagtgcggccaccacgccttcagcgactac

SEQ ID NO: 3748 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgttgccaccacttacttccctctcctccctcaccctctctcctacatggcctctctactgggcctgccagggctgcgtcctaaccggcgtctgggtcatagcccacgagtgcggccaccacgccttcagcgactac

SEQ ID NO: 3749 - DNA, 349 bp, Artificial
  Mutation in BnaA.FAD2.a introduced by TALE nuclease pair BnFAD2_T01
caggatccatgggtgcaggtggaagaatgcaagtgactcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 3750 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacggcctctctactgggcctgccaggggtgcgtcctaaccggcgtcggggtcatcgcccacgagtccggccaccacgccttcagcgactac

SEQ ID NO: 3751 - DNA, 345 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgcctctctactgggcctgccagggctgcgtcctaaccggcgtctgggtcatagcccacgagtgcggccaccacgccttcagcgactac

SEQ ID NO: 3752 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcctctctactgggcctgccaaggctgcgtcctaacgggcctctgggtcatagcccacgagtgcggccaccacgccttcagcgactac

SEQ ID NO: 3753 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacaggcctctctactgggcctgccagggctgcgtcctaaccggcgtctgggtcatagcccacgagtgcggccaccacgccttcagcgactac

SEQ ID NO: 3754 - DNA, 348 bp, Artificial
  Mutation in BnaA.FAD2.a introduced by TALE nuclease pair BnFAD2_T01
caggatccatgggtgcaggtggaagaatgctagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaaggctgcgtcctaacgggcctctgggtcatcgcccacgaatgcggccaccacgccttcagcgactac

SEQ ID NO: 3755 - DNA, 351 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccaccattcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttctgggcctctctactgggccggccaagggtgcgtcctaaccggcgtctgggtcatagcccacgagtgcggccaccacgccttcagcgactac

SEQ ID NO: 3756 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctaggcctctctactgggcctgccagggctgcgtcctaaccggcgtctgggtcatagcccacgagtgcggccaccacgccttcagcgactac

SEQ ID NO: 3757 - DNA, 318 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttggcaggcctctctactgggcctgccaagggtgcgtcctaaccggcgtctgggtcatagcccacgagtgcggccaccacgccttcagcgactac

SEQ ID NO: 3758 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctacctcaccctctctcctactcctctctactgggcctgccagggctgcgtcctaaccggcgtctgggtcatagcccacgagtgcggccaccacgccttcagcgactac

SEQ ID NO: 3759 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctccccctctctcctccttcctggcctctctactgggcctgccaagggtgcgtcctaaccggcgtctgggtcatagcccacgagtgcggccaccacgccttcagcgactac

SEQ ID NO: 3760 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccgtggcctctctactgggcctgccagggctgcgtcctaaccggcgtctgggtcatatcccacgagtgcggccaccacgccttcagcgactac

SEQ ID NO: 3761 - DNA, 343 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttctctactgggcctgccagggctgcgtcctaacgggcctctgggtcatagcccacgagtgcggccaccacgccttcagcgactac

SEQ ID NO: 3762 - DNA, 405 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcaatgcactgacgggtgccccgctcaacttgaccccccagcaggtggtggccatcggcctctctactgggcctgccaagggtgcgtcctaaccggcgtctgggtcatagcccacgagtgcggccaccacgccttcagcgactac

SEQ ID NO: 3763 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtgtgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccagggctgcgtcctaaccggcgtctgggtcatagcccacgagtgcggccaccacgccttcagcgactcc

SEQ ID NO: 3764 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacacctcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacctcgccgcgcctctactgggcctgccagggctgcgtcctaaccggcctctgggtcatagcccacgagtgcggccaccacgccttcagcgactac

SEQ ID NO: 3765 - DNA, 354 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctggcctctctactgggcctgccaaggctgcgtcctaacgggcctctgggtcatagcccacgagtgcggccaccacgccttcagcgactac

SEQ ID NO: 3766 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgctagggctgcgtcctaaccggcgtctgggtcatagcccacgagtgcggccaccacgccttcagcgactac

SEQ ID NO: 3767 - DNA, 339 bp, Artificial
  Mutation in BnaA.FAD2.a introduced by TALE nuclease pair BnFAD2_T01
caggatccatgggtgcaggtgtaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacttcgccaccacttacttccctctcctccctcaccctctctcctctctactgggccggccaagagtgcgtcctcaccggcgtctgggtcatagccctcgagtgcggccaccacgcctccagcgactcc

SEQ ID NO: 3768 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaacgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgaatgcggccaccacgccttcagcgactac

SEQ ID NO: 3769 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccaaggctgcgtcctaacgggcctctgggtcatcgcccacgaatgcggccaccacgccttcagcgactac

SEQ ID NO: 3770 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatcctctctactgggcctgccagggctgcgtcctaaccggcgtctgggtcatagtccacgagtgcggccaccacgccttcagcgactac

SEQ ID NO: 3771 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgagacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 3772 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcctctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 3773 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctcttcgacatcatcatagcctcctgcttctactacgtcgccaccacttacttccctctcctccctcaccctctctcctactctctactgggcctgccagggctgcgtcctaaccggcgtctgggtcatagcccacgagtgcggccaccacgccttcagcgactac

SEQ ID NO: 3774 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcggctctctactgggcctgccaagggtgcgtcctaaccggcgtctgggtcatagcccacgagtgcggccaccacgccttcagcgactac

SEQ ID NO: 3775 - DNA, 342 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcggcctctctactgggcctgccaagggtgcgtcctaaccggcgtctgggtcatagcccacgagtgcggccaccacgccttcagcgactac

SEQ ID NO: 3776 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaatcgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctggcctctctactgggcctgccaaggctgcgtcctaacgggcctctgggtcatagcccacgagtgcggccaccacgccttcagcgactac

SEQ ID NO: 3777 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccggcctctctactgggcctgccaagggtgcgtcctaaccggcgtctgggtcatagcccacgagtgcggccaccacgccttcagcgacac

SEQ ID NO: 3778 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccagggctgcgtcctaacgggcctctgggtcatcgcccacgaatgcggccaccacgccttcagcgactac

SEQ ID NO: 3779 - DNA, 336 bp, Artificial
  Mutation in BnaA.FAD2.a introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatagcctcctgcttctactacgtcgccaccacttacttccctctcctccctcaccctctctcctacttctctactgggcctgccagggctgcgtcctaaccggcgtctgggtcatagcccacgagtgcggccaccacgccttcagcgactac

SEQ ID NO: 3780 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcgtcttggtcatagcccacgagtgcggccaccacgccttcagcgactac

SEQ ID NO: 3781 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaacctacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttaccttggcccctctactgggcctgccaaggctgcgtcctaacgggcctctgggtcatagcccacgagtgcggccaccacgccttcagcgactac

SEQ ID NO: 3782 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccagggctgcgtcctaacgggcctctgggtcatagcccacgagtgcagccaccacgccttcagcgactac

SEQ ID NO: 3783 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttctctactgggcctgccagggctgcgtcctaaccggcgtctgggtcatagcccacgagtgcggccaccacgccttcagcgactac

SEQ ID NO: 3784 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccactgcctctctactgggcctgccagggctgcgtcctaaccggcgtctgggtcatagcccacgagtgcggccaccacgccttcagcgactac

SEQ ID NO: 3785 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcccgccctggcctctctactgggcctgccagggctgcgtcctaaccggcgtctgggtcatagcccacgagtgcggccaccacgccttcagcgactac

SEQ ID NO: 3786 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgttggcgctggcctctctactgggcctgccagggctgcgtcctaaccggcgtctgggtcatagcccacgagtgcggccaccacgccttcagcgactac

SEQ ID NO: 3787 - DNA, 339 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttactgggcctgccagggctgcgtcctaaccggcgtctgggtcatagcccacgagtgcggccaccacgccttcagcgactac

SEQ ID NO: 3788 - DNA, 331 bp, Artificial
  Mutation in BnaA.FAD2.a introduced by TALE nuclease pair BnFAD2_T01
caggatccattggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgggcctgccagggctgcgtcctaaccggcgtctgggtcatagcccacgagtgcggccaccacgccttcagcgactac

SEQ ID NO: 3789 - DNA, 335 bp, Artificial
  Mutation in BnaA.FAD2.a introduced by TALE nuclease pair BnFAD2_T01
caggatccatgggtgcaggtcgaagaatgcaagtctctcctccctccagctcccccgaaaccaaaaccctcaaacgcgtcccctgcgagacaccccccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctactgggcctgccagggctgcgtcctaaccggcgtctgggtcatagcccacgagtgcggccaccacgccttcagcgactac

SEQ ID NO: 3790 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctccttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 3791 - DNA, 341 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgggcctgccaggactgcgtcctaaccggcgtctgggtcatagcccacgaatgcggccaccacgccttcagcgactac

SEQ ID NO: 3792 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccccccccctctctcctgcctctctactgggcctgccagggctgcgtcctaaccggcgtctgggtcatagcccacgagtgcggccaccacgccttcagcgactac

SEQ ID NO: 3793 - DNA, 340 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacatcatctgggacatcatcatagcctcctgcttctactacgtcgccaccacttacttccctctcctccctcaccctctctcctactttactgggcctgccagggctgcgtcctaaccggcgtctgggtcatagcccacgagtgcggccaccacgccttcagcgactac

SEQ ID NO: 3794 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtcccctgcgagacaccacccttcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttccctctctactgggcctgccagggctgcgtcctaaccggcgtctgggtcatagcccacgagtgcggccaccacgccttcagcgactac

SEQ ID NO: 3795 - DNA, 343 bp, Artificial
  Mutation in BnaA.FAD2.a introduced by TALE nuclease pair BnFAD2_T01
caggatcatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatcctctctactgggcctgccagggctgcgtcctaaccggcgtctgggtcatagcccacgagtgtggccaccacgccttcagcgactac

SEQ ID NO: 3796 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatcttggacatcatcatagcctcctgcttctactacgtcgccaccacttacttccctctcctccctcaccctctctcctacttctctactgggcctgccaagggtgcgtcctaaccggcgtctgggtcatagcccacgagtgcggccaccacgccttcagcgactac

SEQ ID NO: 3797 - DNA, 354 bp, Artificial
  Mutation in BnaA.FAD2.a introduced by TALE nuclease pair BnFAD2_T01
caggatccatgggtgcaggtggaagaatgcaagtgtcgcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctggcacatcatcatagcctcctgcttctactacgtcgccaccacttacttccctctcctccctcaccctctctcctccttcgccctggcctctctactgggcctgccagggctgcgtcctaaccggcgtctgggtcatagcccatgagtgcggccaccacgccttcagcgacaac

SEQ ID NO: 3798 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgcaagggctgcgtcctaaccggcgtctgggtcatagcccacgagtgcggccaccacgccttcagcgactac

SEQ ID NO: 3799 - DNA, 386 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggccaccacctgctggggggtcaagccgtgggcctggcacagtctctactgggcctgccagggctgcgtcctaaccggcgtctgggtcatagcccacgagtgcggccaccacgccttcagcgactac

SEQ ID NO: 3800 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaacgggcctctgggtcatcgcccacgaatgcggccaccacgccttcagcgactac

SEQ ID NO: 3801 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcccctctactgggcctgccagggctgcgtcctaacgggcctctgggtcatagcccacgagtgcggccaccacgccatcagcgactac

SEQ ID NO: 3802 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 3803 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctattacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 3804 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcccctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 3805 - DNA, 341 bp, Artificial
  Mutation in BnaA.FAD2.a introduced by TALE nuclease pair BnFAD2_T01
caggatccatgggtgcaggtggaagaatgcaagtgtctcctccctccaagaggtctgaaaccgacaacatcaagcgcgtaccctgcgagacaccaccattcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgggcctgccagggctgcgtcctaaccggcgtctgggtcatagcccacgagtgcggccaccacgccttcagcgactac

SEQ ID NO: 3806 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgctttggcctctctactgggcctgccagggctgcgtcctaaccggcgtctgggtcatagcccacgagtgcggccaccacgccttcagcgactac

SEQ ID NO: 3807 - DNA, 426 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttatggacgccaactacctctgatagttgagtcgatacttcggcgatcaccgcttccctcataatgtttaactttgttttggcctctctactgggcctgccagggctgcgtcctaaccggcgtctgggtcatagcccacgagtgcggccaccacgccttcagcgactac

SEQ ID NO: 3808 - DNA, 352 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggccttcatcctaccctcctgcttctactccgccgccaccactttcttccctctcctccctccccccctcccctcctccgctggcccctctactgggcctgccagggctgcgtcctaaccggcgtctgggtcatagcccacgagtgcgaccaccacgccttcagcgactac

SEQ ID NO: 3809 - DNA, 346 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccagggctgcgtcctaaccggcgtctgggtcatagcccacgagtgcggccaccacgccttcagcgactac

SEQ ID NO: 3810 - DNA, 348 bp, Artificial
  Mutation in BnaA.FAD2.a introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgaatgcggccaccacgccttcagcgactac

SEQ ID NO: 3811 - DNA, 393 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttcaactacgtcgccaccacttacttccctctcctccctcaccctctctcctacactgggcctttcgttttatctgttgtttgtcggtgaacgctctccttggcctctctactgggcctgccaagggtgcgtcctaaccggcgtctgggtcatagcccacgagtgcggccaccacgccttcagcgactac

SEQ ID NO: 3812 - DNA, 430 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttatgtacggccagcagcgtcggttcgagatggcgctcgatgacgccaacgatggccaccacctgctccggggtcaagccagttggcctctctactgggcctgccagggctgcgtcctaaccggcgtctgggtcatagcccacgagtgcggccaccacgccttcagcgactac

SEQ ID NO: 3813 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcccttggcctctctactgggcctgccagggctgcgtcctaaccggcgtctgggtcatagcccacaagtgcggccaccacgccttcagcgactac

SEQ ID NO: 3814 - DNA, 324 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcttgccaagggtgcgtcctaaccggcgtctgggtcatagcccacgagtgcggccaccacgccttcagcgactac

SEQ ID NO: 3815 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctactgggcctgccagggctgcgtcctaaccggcgtctgggtcatagcccacgagtgcggccaccacgccttcagcgactac

SEQ ID NO: 3816 - DNA, 331 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctccgggcctgccagggctgcgtcctaaccggcgtctgggtcatagcccacgagtgcggccaccacgccttcagcgactac

SEQ ID NO: 3817 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtctccaccacttacttccctctcctccctcaccctctctcctaggcctctctactgggcctgccagggctgcgtcctaacgggcctctgggtcatcgcccacgaatgcggccaccacgccttcagcgactac

SEQ ID NO: 3818 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctgacccctctactgggcctgccaaggctgcgtcctaacgggcctctgggtcatcgcccacgaatgcggccaccacgccttcagcgactac

SEQ ID NO: 3819 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaccgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 3820 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgcttcagcgactac

SEQ ID NO: 3821 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 3822 - DNA, 335 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccagggctgcgtcataaccggcgtctgggtcatagcccacgagtgcggccaccacgccttcagcgactac

SEQ ID NO: 3823 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtctgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtcttggtcatatcccgcgagtgcggccaccacgccttcagcgactac

SEQ ID NO: 3824 - DNA, 338 bp, Artificial
  Mutation in BnaA.FAD2.a introduced by TALE nuclease pair BnFAD2_T01
caggatccatgggtgcaggtgtaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccctctctactgggcctgccaagggtgcgtcctaaccggcgtctgggtcatagcccacgagtgcggccaccacggcttcagcgactac

SEQ ID NO: 3825 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgtggcctctctactgggcctgccagggctgcgtcctaaccggcgtctgggtcatagcccacgagtgcggccaccacgccttcagcgactac

SEQ ID NO: 3826 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatctcctcctcggctcctccctctaccacctctccacagcctacttccctctcctcccccacccgcctggcccctctactgggcctgccaaggctgcgtcctaacgggcctctgggtcatcgcccacgaatgcggccaccacgccttcagcgactac

SEQ ID NO: 3827 - DNA, 341 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctactgggcctgccagggctgcgtcctaaccggcgtctgggtcatagcccacgagtgcggccaccacgccttcagcgactac

SEQ ID NO: 3828 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccagggctgcgtcctaaccggcgtctgggtcatagccctcgagtgcggccaccacgccttcagcgactac

SEQ ID NO: 3829 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagtgtggccaccacgccttcagcgactac

SEQ ID NO: 3830 - DNA, 356 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgccgcctggcctctctactgggcctgccagggctgcgtcctaaccggcgtctgggtcatagcccacgagtgcggccaccacgccttcagcgactac

SEQ ID NO: 3831 - DNA, 343 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttctctactgggcctgccagggctgcgtcctaaccggcgtctgggtcatagcccacgagtgcggccaccacgccttcagcgactac

SEQ ID NO: 3832 - DNA, 334 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcacccactctctactgggcctgccagggctgcgtcctcaccggcgtctgggtcatagcccacgagtgcggccaccacgccttcagcgactac

SEQ ID NO: 3833 - DNA, 350 bp, Artificial
  Mutation in BnaA.FAD2.a introduced by TALE nuclease pair BnFAD2_T01
caggatccatgggtgcaggtggaagaatgtaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttggcctctctactgggcctgccaagggtgcgtcctaaccggcgtctgggtcatagcccacgagtgcggccaccacgccttcagcgactac

SEQ ID NO: 3834 - DNA, 349 bp, Artificial
  Mutation in BnaA.FAD2.a introduced by TALE nuclease pair BnFAD2_T01
cagtatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgctggcctctctactgggcctgccagggctgcgtcctaaccggcgtctgggtcatagcccacgagtgcggccaccacgccttcagcgactac

SEQ ID NO: 3835 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccccttacttccctctcctccctccccctctctcctactcctggcctctctactgggcctgccagggctgcgtcctaacgggcctctgggtcatagcccacgagtgcggccaccacgccttcagcgactac

SEQ ID NO: 3836 - DNA, 346 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgagtgcggccaccacgccttcagcgactac

SEQ ID NO: 3837 - DNA, 357 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctccgcccgcctggcctctctactgggcctgccagggctgcgtcctaaccggcgtctgggtcatagcccacgagtgcggccaccacgccttcagcgactac

SEQ ID NO: 3838 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccagcgtctgggtcatagcccacgagtgcggccaccacgccttcagcgactac

SEQ ID NO: 3839 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcctctctactggccctgccaaggctgcgtcctaacgggcctctgggtcatagcccacgagtgcggccaccacgccttcagcgactac

SEQ ID NO: 3840 - DNA, 357 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgcccgcctggcctctctactgggcctgccagggctgcgtcctaaccggcgtctgggtcatagcccacgagtgcggccaccacgccttcagcgactac

SEQ ID NO: 3841 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccaccattcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 3842 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgcctttggcctctctactgggcctgccaagggtgcgtcctaaccggcgtctgggtcatagcccacgagtgcggccaccacgccttcagcgactac

SEQ ID NO: 3843 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctggcacatcatcatagcctcctgcttctactacctcgcccccactttcttccctctcctccctcaccctctctccgccttggcctctctactgggcctgccaagggtgcgtcctaaccggcgtctggtcatagcccacgagtgcggccaccacgccttcagcgactac

SEQ ID NO: 3844 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcggcctctctactgggcctgccagggctgcgtcctaaccggcgtctgggtcatagcccacgagtgcgaccaccacgccttcagcgactac

SEQ ID NO: 3845 - DNA, 429 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatcttggacatcatcatagcctcctgcttctactacgtcgcgaccacttacttctctctcctccctcaccctctctccgacttcgagcgtccggcccgccaccctccgggccgttgcttcacaccatcgtggctggcgatggccaccacctgctccggggtcatggcctctctactgggcctgccagggctgcgtcctaaccggcgtctgggtcatagcccacgagtgcggccaccacgccttcagcgactac

SEQ ID NO: 3846 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaaggaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 3847 - DNA, 335 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccagggctgcgtcctaaccggcgtctgggtcatagcccacgagtgcggccaccacgccttcagcgactac

SEQ ID NO: 3848 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctactgggcctgccagggctgcgtcctaacgggcctctgggtcatagcccacgagtgcggccaccacgccttcagcgactac

SEQ ID NO: 3849 - DNA, 339 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccggcctgccagggcttcgtcctaaccggcgtctgggtcatagcccacgagtgcggccaccacgccttcagcgactac

SEQ ID NO: 3850 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctcctctctactgggcctgccaagggtgcgtcctaaccggcgtctgggtcatagcccacgagtgcggccaccacgccttcagcgactac

SEQ ID NO: 3851 - DNA, 332 bp, Artificial
  Mutation in BnaA.FAD2.a introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccagggctgcgtcctaaccggcgtctgggtcatagcccacgagtgcggccaccacgccttcagcgactac

SEQ ID NO: 3852 - DNA, 344 bp, Artificial
  Mutation in BnaA.FAD2.a introduced by TALE nuclease pair BnFAD2_T01
caggatccatgggtgcaggtgtaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatcctctctactgggcctgccagggctgcgtcctaaccggcgtctgggtcatagcccacgagtgcggccaccacgccttcagcgactac

SEQ ID NO: 3853 - DNA, 344 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccaagggtgcgtcctaaccggcgtctgggtcatagcccacgagtgcggccaccacgccttcagcgactac

SEQ ID NO: 3854 - DNA, 340 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccacccgcctggcccctctactgggcctgccaaggctgcgtcctaacgggcctctgggtcatagcccacgagtgcggccaccacgccttcagcgactac

SEQ ID NO: 3855 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtggcctctctactgggcctgccaagggtgcgtcctaaccggcgtctgggtcatagcccacgagtgcggccaccacgccttcagcgactac

SEQ ID NO: 3856 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccaagggtgcgtcctaacgggcctctgggtcatagcccacgagtgcggccaccacgccttcagcgactac

SEQ ID NO: 3857 - DNA, 325 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggctgcgtcctaaccggcgtctgggtcatagcccacgagtgcggccaccacgccttcagcgactac

SEQ ID NO: 3858 - DNA, 356 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccagggctgcgtcctaaccggcgtctgggtcatagcccacgagtgcggccaccacgccttcagcgactac

SEQ ID NO: 3859 - DNA, 354 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggtggcctctctactgggcctgccagggctgcgtcctaaccggcgtctgggtcatagcccacgagtgcggccaacacgccttcagcgactac

SEQ ID NO: 3860 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtacccttcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcgcctggcccctctactgggcctgccaaggctgcgtcctaacgggcctctgggtcatcgcccacgaatgcggccaccacgccttcagcgactac

SEQ ID NO: 3861 - DNA, 354 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctttggcctctctactgggcctgccaagggtgcgtcctaaccggcgtctgggtcatagcccacgagtgcggccaccacgccttcagcgactc

SEQ ID NO: 3862 - DNA, 341 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgggcctgccagggctgcgtcctaaccggcgtctgggtcatagcccacgagtgcggccaccacgccttcagcgactac

SEQ ID NO: 3863 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcaggcctctctactgggcctgccaagggtgcgtcctaaccggcgtctgggtcatagcccacgagtgcggccaccacgccttcagcgactac

SEQ ID NO: 3864 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatctctactgggcctgccagggctgcgtcctaaccggcgtctgggtcatagcccacgagtgcggccaccacgccttcagcgactac

SEQ ID NO: 3865 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccagcgtctgggtcatagcccacgagtgcggccaccacgccttcagcgactac

SEQ ID NO: 3866 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcacacgagtgcggccaccacgccttcagcgactac

SEQ ID NO: 3867 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcgtcctggcctctctactgggcctgccaagggtgcgtcctaaccggcgtctgggtcatagcccacgagtgcggccaccacgccttcagcgactac

SEQ ID NO: 3868 - DNA, 300 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgtgacatcatcatagcctcctgcttctactacgtctctctactgggcctgccaagggtgcgtcctaaccggcgtctgggtcatagcccacgagtgcggccaccacgccttcagcgactac

SEQ ID NO: 3869 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatcgcccgcgagtgcggccaccacgccttcagcgactac

SEQ ID NO: 3870 - DNA, 386 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtggccaccacctgctggggggtcaagccgtgggcctggcacagtctctactgggcctgccagggctgcgtcctaaccggcgtctgggtcatagcccacgagtgcggccaccacgccttcagcgactac

SEQ ID NO: 3871 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccatcgctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgagtgcggccaccacgccttcagcgactac

SEQ ID NO: 3872 - DNA, 347 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttccctctctactgggcctgccagggctgcgtcctaaccggcgtctgggtcatagcccacgagtgcggccaccacgccttcagcgactac

SEQ ID NO: 3873 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccccccccctctcccttacctctggcccctctactgggcctgccaaggctgcgtcctaacgggcctctgggtcatagcccacgagtgcggccaccacgccttcagcgactac

SEQ ID NO: 3874 - DNA, 300 bp, Artificial
  Mutation in BnaA.FAD2.a introduced by TALE nuclease pair BnFAD2_T01
caggatccatgggtgcaggtggaagaatgcaagtgtctcctccctccaaaaactctgacaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgcctctctactgggcctgccaagggtgcgtcctaaccggcgtctgggtcatcgcccacgagtgcggccaccacgccttcagcgactac

SEQ ID NO: 3875 - DNA, 348 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactagacctctctacagggccggccaggactgcgtcctaaccggcgtctggctcatagcccgcgagtgcggccaccacgccttcagcgactac

SEQ ID NO: 3876 - DNA, 339 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtacactgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttactgggcctgccagggctgcgtcctaaccggcgtctgggtcatagcccacgagtgcggccaccacgccttcagcgactac

SEQ ID NO: 3877 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctacctggcctctctactgggcctgccagggctgcgtcctaaccggcgtctgggtcatagcccacgagtgcggccaccacgccttcagcgactac

SEQ ID NO: 3878 - DNA, 347 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcgcctctctactgggcctgccagggctgcgtcctaaccggcgtctgggtcatagcccacgagtgcggccaccacgccttcagcgactac

SEQ ID NO: 3879 - DNA, 342 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccacactgtttcaaacgctcgatccctcgctctttctcctacctcatctgggacatcatcatagcctcctgcttctactacgtcgccaccacttacttccctctcctccctcaccctcccccctcctctctactgggcctgcccgggctgcgtcctcaccggcgtctgggtcatagcccacgagtgcggccaccacgccctcagcgactac

SEQ ID NO: 3880 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggccactctactgggcctgccaagggtgcgtcctaacgggcctctgggtcatagcccacgagtgcggccaccacgcctgcagcgactac

SEQ ID NO: 3881 - DNA, 342 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccaaggctgcgtcctaacgggcctctgggtcatagcccacgagtgcggccaccacgccttcagcgactac

SEQ ID NO: 3882 - DNA, 344 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctcacctggcctctctactgggcctgccagggctgcgtcctaacgggcctctgggtcatagcccacgagtgcggccaccacgccttcagcgactac

SEQ ID NO: 3883 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctggcctctctactgggcctgccaaggctgcgtcctaacgggcctctgggtcatcgcccacgaatgcggccaccacgccttcagcgactac

SEQ ID NO: 3884 - DNA, 355 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcgcctggcctctctactgggcctgccagggctgcgtcctaaccggcgtctgggtcatagcccacgagtgcggccaccacgccttcagcgactac

SEQ ID NO: 3885 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaggcctgcgtcctaaccggcgtctgggtcatagcccacgagtgcggccaccacgccttcagcgactac

SEQ ID NO: 3886 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctaatacgtcgccaccacttacttccctctcctccctcaccctctctcctaccgccctggcctctctactgggcctgccagggctgcgtcctaaccggcgtctgggtcatagcccacgagtgcggccaccacgccttcagcgactac

SEQ ID NO: 3887 - DNA, 350 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcgcctgcgagacaccaccattcactctcggagacctcaagaaagcaatcccacctcactgcttcaaacgctcgatccctcgctctttctcctacctcatctgggacatcatcatagcctcctgcttctactacgtcgccaccccttacttccctctcctccctccccctctctcctccccctggcctctctactgggcctgccagggctgcgtcctaacctgcgtctgggtcatagcccacgagtgcggccaccacgccttcagcgactac

SEQ ID NO: 3888 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccagggctgcgtcctcaccggcgtctgggtcatagcccacgagtgcggccaccacgccttcagcgactac

SEQ ID NO: 3889 - DNA, 441 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccaactggtggccatcgccagccacgatggtggcaagcaggcgctggagacggtccagcggctgttgccggtgctgtgccaggcccacggcttgacccctggcctctctactgggcctgccaagggtgcgtcctaaccggcgtctgggtcatagcccacgagtgcggccaccacgccttcagcgactac

SEQ ID NO: 3890 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgaatgcggccaccacgccttcagcgactac

SEQ ID NO: 3891 - DNA, 335 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcctctctactgggcctgccagggctgcgtcctaaccggcgtctgggtcatagcccacgagtgcggccaccacgccttcagcgactac

SEQ ID NO: 3892 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctccgcttctactacgtcgccaccacttacttccctctcctccctcaccctctctcctacttggcctctctactgggcctggcaagggtgcgtcctaaccggcgtctgggtcatagcccacgagtgcggccaccacgccttcagcgactac

SEQ ID NO: 3893 - DNA, 348 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcattgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccccgcctggcctctctactgggcctgccaagggtgcgtgctaaccggcgtctgggtcatagcccacgagtgcggccaccacgccttcagcgactac

SEQ ID NO: 3894 - DNA, 334 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatgcctcgctctttctcctacctcatctgggacatcatcatagcctcctgcttctactacgtcgccaccacttacttccctctcctccctcaccctctctctactgggcctgccagggctgcgtcctaaccggcgtctgggtcatagcccacgagtgcggccaccacgccttcagcgactac

SEQ ID NO: 3895 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaacgcctgaaaccgacaacatcaagcgcgtaccctgcgagacaccgcccttcactgtcggagaactcaagaaagcaatcccaccgcactgtttcaaacgctcgatccctcgctccttctcctccctcatctggtacttcatcataccctcctgcttctactaccccgccaccactttctttcctctcctccctctccctctctcctcctggcctctctactgggcctgccagggctgcgtcctaaccggcgtctgggtcatagcccacgagtgcggccaccacgccttcagcgactac

SEQ ID NO: 3896 - DNA, 331 bp, Artificial
  Mutation in BnaA.FAD2.a introduced by TALE nuclease pair BnFAD2_T01
caggatccatgggtgcaggtggaagaattcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgggcctgccagggctgcgtcctaacgggcctctgggtcatagcccacgagtgcggccaccacgccttcagcgactac

SEQ ID NO: 3897 - DNA, 352 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggcctctctactgggcctgccagggctgcgtcctaaccggcgtctgggtcatagcccgcgagtgcggccaccacgccttcagcgactac

SEQ ID NO: 3898 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccagggctgcgtcctaactggcgtctgggtcatagcccacgagtgcggccaccacgccttcagcgactac

SEQ ID NO: 3899 - DNA, 277 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacttcacgccttcagcgactac

SEQ ID NO: 3900 - DNA, 347 bp, Artificial
  Mutation in BnaA.FAD2.a introduced by TALE nuclease pair BnFAD2_T01
caggatccatgggtgcaggtggaagaatgcaagtgtctcctccatccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 3901 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgcctccacttacttccctctcctccctcaccctccctcctccttctggcctctctactgggcctgccagggctgcgtcctaaccggcgtctgggtcatagcccacgagtgcggccaccacgccttcagcgactac

SEQ ID NO: 3902 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactcggcctgccagggctgcgtcctaaccggcgtctgggtcatagcccacgaggacggccaccacgccatcagcgactac

SEQ ID NO: 3903 - DNA, 342 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccagggctgcgtcctcaccggcgtctgggtcatagcccacgagtgcggccaccacgccttcagcgactcc

SEQ ID NO: 3904 - DNA, 352 bp, Artificial
  Mutation in BnaA.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccgccctggcctctctactggtcctgccagggctgcgtcctaaccggcgtctgggtcatagcccacgagtgcggccaccacgccttcagcgactac

SEQ ID NO: 3905 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttggcctctctactgggcctgccagggctgcgtcctaaccggcgtctgggtcatagcccacgagtgcggccaccacgccttcagcgactac

SEQ ID NO: 3906 - DNA, 339 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctactgggcctgccagggctgcgtcctaaccggcgtctgggtcatagcccacgagtgcggccaccacgccttcagcgactac

SEQ ID NO: 3907 - DNA, 356 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccagggctgcgtcctaaccggcgtctgggtcatagcccacgagtgcggccaccacgccttcagcgactac

SEQ ID NO: 3908 - DNA, 388 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggtccagcgcctgcttgccaccattattgctggcgatggccaccacctgctgggcctgccagggctgcgtcctaaccggcgtctgggtcatagcccacgagtgcggccaccacgccttcagcgactac

SEQ ID NO: 3909 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgatcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgccttcagcgactac

SEQ ID NO: 3910 - DNA, 349 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctgcctctttactgggcctgccagggctgcgtcctaaccggcgtctgggtcatagcccacgagtgcggccaccacgccttcagcgactac

SEQ ID NO: 3911 - DNA, 450 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgaaaacggcttgtcccgcgtcatcggcgggggtcataacgtgactcccttaaggcagtgcatgcatggcgcaatgcactgacgggtgccccgctcaactttggcctctctactgggcctgccagggctgcgtcctaacgggcctctgggtcatagcccacgagtgcggccaccacgccttcagcgactac

SEQ ID NO: 3912 - DNA, 403 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggatacctgtccgcctttctcccttcgggaagcgtggcgctttctcatagctcaggcctctctactgggcctgccagggctgcgtcctaaccggcgtctgggtcatagcccacgagtgcggccaccacgccttcagcgactac

SEQ ID NO: 3913 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacctcgcctctctactgggcctgccaaggctgcgtcctaaccggcgtctgggtcatagcccacgagtgcggccaccacgccttcagcgactac

SEQ ID NO: 3914 - DNA, 325 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctccttcctcatctgggacatcaccatagcctcctgcttctactacgtcgccaccacttacttccctctcctccctcaccctctctcctacttggctgcgtcctaaccggcctctgggtcatagcccacgagtgcggccaccacgccttcagcgactac

SEQ ID NO: 3915 - DNA, 424 bp, Artificial
  Mutation in BnaA.FAD2.a introduced by TALE nuclease pair BnFAD2_T01
caggatccatgggtgcaggtgcaagaatgcaagtgtctcctcactccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccccactgggccaggcccacggcttgaccccggagcaggtggtggccatcgccagccacgatggcggcaagcaggcgctggactggcctctctactgggcctgccggggctgcgtcctaaccggcgtctgggtcatagcccacgagtgcggccaccacgccttcagcgactac

SEQ ID NO: 3916 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccctggcctctctactgggcctgccaagggtgcgtcctaaccggcgtctgggtcatagcccacgagtgcggccaccacgccttcagcgactac

SEQ ID NO: 3917 - DNA, 349 bp, Artificial
  Mutation in BnaA.FAD2.a introduced by TALE nuclease pair BnFAD2_T01
caggatccattggtgcaggtggaagaatgcaagtgtctcctccctccaagaagtctgaaaccgacaccatcaagcgcgtaccctgcgagacaccgccctttactgtcggagaactcaagaaagcaatcccaccgcactgtttcaaacgctcgatccctcgctctttctcctcttcgacatcatcatctcctcctcggctcctccctctaccacctctccacagcctacttccctctcctccctcaccctctctcctacttggcctctctactgggcctgccagggctgcgtcctaaccggcgtctgggtcatagcccacgagtgcggccaccacgccttcagcgactac

SEQ ID NO: 3918 - DNA, 334 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttcactctcctccctcaccctctctctactgggcctgccaagggtgcgtcctaaccggcgtctgggtcatagcccacgagtgcggccaccacgccttaagcgactac

SEQ ID NO: 3919 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgccctgtttcaaacgctcgatccctcgctctttctcctacctcatctgggacatcatcatagcctcctgcttctactacgtcgcccccacttacttccctctcctccctcaccctctctcctcccctggcctctctactgggcctgccaagggtgcgtcctaaccggcgtctgggtcatagcccacgagtgcggccaccacgccttcagcgactac

SEQ ID NO: 3920 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttctactgggcctgccagggctgcgtcctaaccggcgtctgggtcatatcccgcgagtgcggccaccacgccttcagcgactac

SEQ ID NO: 3921 - DNA, 432 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccaccattcactctcggagacctcaagaaagcaatcccacctcactgcttcaaacgctccatcccacgctccttctcctcttcgacatcatcatcgcctcctgcttctactaccccaccaccactcactcccctcccctccctcaccctctctcctaggccctcctcctgcttgccgccatcgtgactggcgatggccaccccctgctcccgggtcaagccgtgggccttgcacagcaccggcaagcacgcgctgtctctactgggcctgccagggcggcgtcctaaccggcgtctgggtcatagcccacgagtgcggccaccacgccttcagcgactac

SEQ ID NO: 3922 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttatggcccctctactgggcctgccaaggctgcgtcctaacgggcctctgggtcatcgcccacgaatgcggccaccacgccttcagcgactac

SEQ ID NO: 3923 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttctaacgctcgatccctcgctctttctcctacctcatctgggacatcatcatagcctcctgcttctactacgtcgccaccacttacttccctctcctccctcaccctctctcctacttcgctggcctctctactgggcctgccagggctgcgtcctaaccggcgtctgggtcatagcccacgagtgcggccaccacgccttcagcgactac

SEQ ID NO: 3924 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctatcctacttctggcctctctactgggcctgccagggctgcgtcctaaccggcgtctgggtcatagcccacgagtgcggccaccacgccttcagcgactac

SEQ ID NO: 3925 - DNA, 341 bp, Artificial
  Mutation in BnaA.FAD2.a introduced by TALE nuclease pair BnFAD2_T01
caggatccatgggtgcaggtggaagaatgcaagtgcctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatctctactgggcctgccaagggtgcgtcctaaccggcgtctgggtcatagcccacgagtgcggccaccacgccttcagcgactac

SEQ ID NO: 3926 - DNA, 348 bp, Artificial
  Mutation in BnaA.FAD2.a introduced by TALE nuclease pair BnFAD2_T01
caggatccatgggtgcaggtgtaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 3927 - DNA, 342 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttactttcctctcctccctcaccctctctcctactctctactgggcctgccagggctgcgtcctaaccggcgtctgggtcatagcccacgagtgcggccaccacgccttcagcgactac

SEQ ID NO: 3928 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccatcagcgactac

SEQ ID NO: 3929 - DNA, 325 bp, Artificial
  Mutation in BnaA.FAD2.a introduced by TALE nuclease pair BnFAD2_T01
caggatccatgggtgcaggtggaagaatgcaagtgtctcctccctccaaaaagcctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccccgacttggctgcgtcctaaccggcgtctgggtcatagcccacgagtgcggccaccacgccttcagcgactac

SEQ ID NO: 3930 - DNA, 325 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggctgcatcctaaccggcgtctgggtcatagcccacgagtgcggccaccacgccttcagcgactac

SEQ ID NO: 3931 - DNA, 339 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccggcctgccagggctgcgtcctaacgggcctctgggtcatcgcccacgaatgcggccaccacgccttcagcgactac

SEQ ID NO: 3932 - DNA, 350 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 3933 - DNA, 335 bp, Artificial
  Mutation in BnaA.FAD2.a introduced by TALE nuclease pair BnFAD2_T01
caggatccatgggtgcaggtggaagaatgcaagtgactcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctactgggcctgccagggctgcgtcctaacgggcctcttggtcatcgcccacgaatgcggccaccacgccttcagcgactac

SEQ ID NO: 3934 - DNA, 348 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 3935 - DNA, 329 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgggcctgccagggctgcgtcctaaccggcgtctgggtcatagcccacgagtgcggccaccacgccttcagcgactac

SEQ ID NO: 3936 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 3937 - DNA, 350 bp, Artificial
  Mutation in BnaA.FAD2.a introduced by TALE nuclease pair BnFAD2_T01
caggatccatgggtgtaggtggaagaatgcaagtgtctcctccctccaaaaagtctgaaaccgacaacatcaagcgcgtaccctgcgagacaccgcccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgaatgcggccaccacgccttcagcgactac

SEQ ID NO: 3938 - DNA, 349 bp, Artificial
  Mutation in BnaA.FAD2.a introduced by TALE nuclease pair BnFAD2_T01
caggatccatgggtgcaggtggaagaatgcaagtgcctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcgccctctctacttggcctgccagggctgcgtcctaaccggcgtctgggtcatagcccacgagtgcggccaccacgccttcagcgactac

SEQ ID NO: 3939 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 3940 - DNA, 260 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcccttaccacgccttcagcgactac

SEQ ID NO: 3941 - DNA, 356 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaaacgcgtcccctgcgagacaccaccattcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccacgccttcagcgactac

SEQ ID NO: 3942 - DNA, 424 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgcgagaaaaaaagagggaaaagagaaataagctgggacatcatcatagcctcctgcttctactacgtcgccaccacttacttccttatcctccctcaccctctctcctacttcgccagcgccggcttgccgccatcgtggctggcgagggccaccacctgctggggggtcaagccgtgggcctggcatggcctctctactgggcctgccaagggtgcgtcctaaccggcgtctgggtcatagcccacgagtgcggccaccacgccttcagcgactac

SEQ ID NO: 3943 - DNA, 344 bp, Artificial
  Mutation in BnaA.FAD2.a introduced by TALE nuclease pair BnFAD2_T01
caggatccattggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccaagggtgcgtcctaaccggcgtctgggtcatagcccacgagtgctgccaccacgcctgcagcgactac

SEQ ID NO: 3944 - DNA, 347 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccagggctgcgtcctaaccggcgtctgggtcatagcccacgagtgcggccaccacgccttcagcgactac

SEQ ID NO: 3945 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctccccctccctaccgggcctgccaagggtgcgtcctaaccggcgtctgggtcatagcccacgagtgcggccaccacgccttcagcgactacc

SEQ ID NO: 3946 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccagggctgcgtcctaaccggcgtctgggtcatagcccacgagtgcggccaccacgccttcagcgactac

SEQ ID NO: 3947 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccccggcctctctactgggcctgccagggctgcgtcctaaccggcgtctgggtcatagcccacgagtgcggccaccacgccttcagcgactac

SEQ ID NO: 3948 - DNA, 354 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttcgcctggcctctctactgggcctgccaagggtgcgtcctaaccggcgtctgggtcatagcccacgagtgcggccaccacgccttcagcgactac

SEQ ID NO: 3949 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacttggcctctctactgggcctgccaagggtgcgtcctaaccggcgtctgggtcatagcccacgagtgcggccaccacgccttcagcgactac

SEQ ID NO: 3950 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccagggctgcgtcctaaccggcgtctgggtcatcgcccacgaatgcggccaccacgccttcagcgactac

SEQ ID NO: 3951 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgtggcctctctactgggcctgccagggctgcgtcctaaccggcgtctgggtcatagcccacgagtgcggccaccacgccttcagcgactac

SEQ ID NO: 3952 - DNA, 358 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgccgggtctggcctctctactaggcctgccagggctgcgtcctaaccggcgtctgggtcatagcccacgagtgcggccaccacgccttcagcgactac

SEQ ID NO: 3953 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaaggctgcgtcctaacgggcctctgggtcatcgcccacgaatgcggccaccacgccttcagcgactac

SEQ ID NO: 3954 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggaaatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 3955 - DNA, 334 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctctttctcctacctcatctgggacatcatcatagcctcctgcttctactacgtcgccaccacttacttccctctcctccctcacccactctctactgggcctgccagggctgcgtcctaaccggcgtctgggtcatagcccacgagtgcggccaccacgccttcagcgactac

SEQ ID NO: 3956 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttacctctctactgggcctgccagggctgcgtcctaaccggcgtctgggtcatagcccacgagtgcggccaccacgccttcagcgactac

SEQ ID NO: 3957 - DNA, 352 bp, Artificial
  Mutation in BnaA.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctcccgccctggcctctctactgggcctgccagggctgcgtcctaaccggcgtctgggtcatagcccacgagtgcggccaccacgccttcagcgactac

SEQ ID NO: 3958 - DNA, 329 bp, Artificial
  Mutation in BnaA.FAD2.a introduced by TALE nuclease pair BnFAD2_T01
caggatccacgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgggcctgccagggctgcgtcctaaccggcgtctgggtcatagcccacgagtgcggccaccacgccttcagcgactac

SEQ ID NO: 3959 - DNA, 338 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattactgggcctgccagggctgcgtcctaaccggcgtctgggtcatagcccactagtgcggccaccacgccttcagcgactac

SEQ ID NO: 3960 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggataactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctcgcctctctactgggcctgccagggctgcgtcctaaccggcgtctgggtcatagcccacgagtgcggccaccacgccttcagcgactac

SEQ ID NO: 3961 - DNA, 346 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccagggctgcgtcctaaccggcgtctgggtcatagcccacgagtgcggccaccacgccttcagcgactac

SEQ ID NO: 3962 - DNA, 348 bp, Artificial
  Mutation in BnaA.FAD2.a introduced by TALE nuclease pair BnFAD2_T01
caggatccatgggtgcaggtggaagaatgcaagtgtctcctccctcccaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggccggccagggctgcgtcctaacgggcctctgggtcatagcccacgagtgcggccaccacgccttcagcgactac

SEQ ID NO: 3963 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcagacgctcgatccctcgctctttctcctacctcatctgggacatcatcatagcctcctgcttctactacgtcgccaccacttacttccctctcctccctcaccctctctcctacctctctactgggcctgccagggctgcgtcctaaccggcgtctgggtcatagcccacgagtgcggccaccacgccttcagcgactac

SEQ ID NO: 3964 - DNA, 339 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctactgggcctgccaaggctgcgtcctaacgggcctctgggtcatcgcccacgaatgcggccaccacgccttcagcgactac

SEQ ID NO: 3965 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctactgggcctgccagggctgcgtcctaaccggcgtctgggtcatagcccacgagtgcggccaccacgccttcagcgactac

SEQ ID NO: 3966 - DNA, 343 bp, Artificial
  Mutation in BnaA.FAD2.a introduced by TALE nuclease pair BnFAD2_T01
caggatccattggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacttctctactgggcctgccagggctgcgtcctaaccggcgtctgggtcatagcccacgagtgcggccaccacgccttcagcgactac

SEQ ID NO: 3967 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctttggcctctctactgggcctgccaagggtgcgtcctaacgggcctctgggtcatcgcccacgaatgcggccaccacgccttcagcgactac

SEQ ID NO: 3968 - DNA, 325 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggctgcgtcctaacgggcctctgggtcatcgcccacgaatgcggccaccacgccttcagcgactac

SEQ ID NO: 3969 - DNA, 349 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcggcctctctactgggcctgccagggctgcgtcctaaccggcgtctgggtcatagcccacgagtgcggccaccacgccttcagcgactac

SEQ ID NO: 3970 - DNA, 339 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcactcaccctctctcctacttcgccggcctgccagggctgcgtcctaaccggcgtctgggtcatagcccacgagtgcggccaccacgccttcagcgactac

SEQ ID NO: 3971 - DNA, 347 bp, Artificial
  Mutation in BnaA.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccagggctgcgtcctaaccggcgtctgggtcatagcccacgagtgcggccaccacgccttcagcgactac

SEQ ID NO: 3972 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactttttcaaacgctcgatccctcgctctttctcctacctcatctgggacatcatcatagcctcctgcttctactacgtcgccaccacttacttccctctcctccctcaccctctctcctacctctctactgggcctgccagggctgcgtcctaacgggcctctgggtcatagcccacgagtgcggccaccacgccttcagcgactac

SEQ ID NO: 3973 - DNA, 351 bp, Artificial
  Mutation in BnaA.FAD2.a introduced by TALE nuclease pair BnFAD2_T01
caggatccatgggtgcaggtggaagaatgcaagtgtctactcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccagggctgcgtcctaaccggcgtctgggtcatagcccacgagtgcggccaccacgccttcagcgactac

SEQ ID NO: 3974 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaaggctgcgtcctaacgggcctctgggtcatcgcccacgaatgcggccaccacgccttcagcgactac

SEQ ID NO: 3975 - DNA, 343 bp, Artificial
  Mutation in BnaA.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctggcctctctactgggcctgccagggctgcgtcctaaccggcgtctgggtcatagcccacgagtgcggccaccacgccttcagcgactac

SEQ ID NO: 3976 - DNA, 357 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccctcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgcccgcctggcctctctactgggcctgccaagggtgcgtcctaaccggcgtctgggtcatagcccacgagtgcggccaccacgccttcagcgactac

SEQ ID NO: 3977 - DNA, 343 bp, Artificial
  Mutation in BnaA.FAD2.a introduced by TALE nuclease pair BnFAD2_T01
caggatccatgggtgcaggtggcagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacctctctactgggcctgccaagggtgcgtcctaaccggcgtctgggtcatagcccacgagtgcggccaccacgccttcagcgactac

SEQ ID NO: 3978 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctggcctctctactgggcctgccagggctgcgtcctaaccggcttctgggtcatagcccacgagggcggccaccacgccttcagcgactac

SEQ ID NO: 3979 - DNA, 346 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccagggctgcgtcctaaccggcgtctgggtcatagcccacgagtgcggccaccacgccttcagcgactac

SEQ ID NO: 3980 - DNA, 351 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccagggctgcgtcctaaccggcgtctgggtcatagcccacgagtgcggccaccacgccttcagcgactac

SEQ ID NO: 3981 - DNA, 335 bp, Artificial
  Mutation in BnaA.FAD2.a introduced by TALE nuclease pair BnFAD2_T01
caggatccacgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcctctctactgggcctgccagggctgcgtcctaaccggcgtctgggtcatagcccacgagtgcggccaccacgccttcagcgactac

SEQ ID NO: 3982 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactttttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgccttcagcgactac

SEQ ID NO: 3983 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcaatccctcgctctttctcctacctcatctgggacatcatcatagcctcctgcttctactacgtcgccaccacttacttccctctcctccctcaccctctctccgacttggcctctctactgggcctgccaaggctgcgtcctaacgggcctctgggtcatcgcccacgaatgcggccaccacgccttcagcgactac

SEQ ID NO: 3984 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcttagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 3985 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgcctgcagcgactac

SEQ ID NO: 3986 - DNA, 355 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcgctggcctctctactgggcctgccagggctgcgtcctaaccggcgtctgggtcatagcccacgagtgcggccaccacgccttcagcgactac

SEQ ID NO: 3987 - DNA, 355 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcgcctggcctctctactgggcctgccagggctgcgtcctaaccggcgtctgggtcatagcccacgagtgcggccaccacgccttcagcgactac

SEQ ID NO: 3988 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcgtccaccacgccttcagcgactac

SEQ ID NO: 3989 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccagggctgcgtcctaacgggcctctgggtcatagcccacgagtgcggccaccacgccttcagcgactac

SEQ ID NO: 3990 - DNA, 354 bp, Artificial
  Mutation in BnaA.FAD2.a introduced by TALE nuclease pair BnFAD2_T01
caggatccatgggtgcaggcggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccttggcctctctactgggcctgccagggctgcgtcctaaccggcgtctgggtcatagcccacgagtgcggccaccacgccttcagcgactac

SEQ ID NO: 3991 - DNA, 337 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctactgggcctgccagggctgcgtcctaaccggcgtctgggtcatagcccacgagttcggccaccacgccttcagcgactac

SEQ ID NO: 3992 - DNA, 339 bp, Artificial
  Mutation in BnaA.FAD2.a introduced by TALE nuclease pair BnFAD2_T01
caggatccatgggtgcaggtggaagaatgcaagtgtctcctccctccagctcccccgaaaccaaaaccctcaaacgcgtcccctgcgagacaccacccttcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgccggcctgccagggctgcgtcctaaccggcgtctgggtcatagcccacgagtgcggccaccacgccttcagcgactac

SEQ ID NO: 3993 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccgcctggcctctctactgggcctgccaagggtgcgtcctaaccggcgtctgggtcatagcccacgagtgcggccaccacgccttcagcgactac

SEQ ID NO: 3994 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcgtagaactcaagaaagcaatcccaccgcactgtttcaaacgctcgatccctcgctctttctcctacctcatctgggacatcatcatagcctcctgcttctactacgtcgccaccacttacttctctctcctccctcaccctctctcctacgtggcctctctactgggcctgccagggctgcgtcctaaccggcgtctgggtcatagcccacgagtgcggcctccacgccagcaatgactac

SEQ ID NO: 3995 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgcctggcctctctactgggcctgccagggctgcgtcctaaccggcgtctgggtcatagcccacgagtgcggccaccacgccttcagcgactac

SEQ ID NO: 3996 - DNA, 357 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcgcgcctggcctctctactgggcctgccagggctgcgtcctaaccggcgtctgggtcatagcccacgagtgcggccaccacgccttcagcgactac

SEQ ID NO: 3997 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaacgggcctctgggtcatagcccacgagtgcggccaccacgccttcagcgactac

SEQ ID NO: 3998 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccaaggctgcgtcctaaccggcgtctgggtcatagcccacgagtgcggccaccacgccttcagcgactac

SEQ ID NO: 3999 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgttccctcgctctttctcctacctcatctgggacatcatcatagcctcctgcttctactacgtcgccaccacttacttccctctcctccctcaccctctctcctacttccctctctactgggcctgccagggctgcgtcctaaccggcgtctgggtcatagcccacgagtgcggccaccacgccttcagcgactac

SEQ ID NO: 4000 - DNA, 348 bp, Artificial
  Mutation in BnaA.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacatggcctctctactgggcctgccagggctgcgtcctaaccggcgtctgggtcatagcccacgagtgcggccaccacgccttcagcgactac

SEQ ID NO: 4001 - DNA, 429 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttgcctccccagcggctgttgccggtgctgtgccaggcccacggcttgacccctcagcaggtggtggccatcgccagccacgatggtggcccctctactgggcctgccaaggctgcgtcctaaccggcgtctgggtcatagccctcgagtgcggccaccacgccttcagcgactac

SEQ ID NO: 4002 - DNA, 350 bp, Artificial
  Mutation in BnaA.FAD2.a introduced by TALE nuclease pair BnFAD2_T01
cattatccattggttcatctttaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgctggcctctctactgcgcctgccaagggtgcgtcctaaccggcgtctggttcatagccctcccctccggccaccacgccttctccccctcc

SEQ ID NO: 4003 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctggcctctctactgggcctgccaaggctgcgtcctaacgggcctctgggtcatagcccacgagtgcggccaccacgccttcagcgactac

SEQ ID NO: 4004 - DNA, 386 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggccaccacctgctggggggtcaagccgtgggcctggcacagtctctactgggcctgccagggctgcgtcctaaccggcgtctgggtcatagcccacgagtgcggccaccacgccttcagcgactac

SEQ ID NO: 4005 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccatctctcctactttggcctctctactgggcctgccaagggtgcgtcctaaccggcgtctgggtcatagcccacgagtgcggccaccacgccgtcagcgactac

SEQ ID NO: 4006 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctcgcctctctactgggcctgccagggctgcgtcctaaccggcgtctgggtcatagcccacgagtgcggccaccacgccttcagcgactac

SEQ ID NO: 4007 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctctactgggcctgccagggctgcgtcctaaccggcgtctgggtcatagcccacgagtgcggccaccacgccttcagcgactac

SEQ ID NO: 4008 - DNA, 345 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctaggcctctctactgggcctgccagggctgcgtcctaaccggcgtctgggtcatagcccacgagtgcggccaccacgccttcagcgactac

SEQ ID NO: 4009 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacgccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccagggctgcgtcctaaccggcgtctgggtcatagcccacgagtgcggccaccacgccttcagcgactac

SEQ ID NO: 4010 - DNA, 339 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctactgggcctgccagggctgcgtcctaaccggcgtctgggtcatagcccacgagtgcggccaccacgccttcagcgactac

SEQ ID NO: 4011 - DNA, 358 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctaacctggcctctctactgggcctgccagggctgcgtcctaaccggcgtctgggtcatagcccacgagtgcggccaccacgccttcagcgactac

SEQ ID NO: 4012 - DNA, 340 bp, Artificial
  Mutation in BnaA.FAD2.a introduced by TALE nuclease pair BnFAD2_T01
caggatccatggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgggcctgccagggctgcgtcctaaccggcgtctgggtcatagcccacgagtgcggccaccacgccttcagcgactac

SEQ ID NO: 4013 - DNA, 347 bp, Artificial
  Mutation in BnaA.FAD2.a introduced by TALE nuclease pair BnFAD2_T01
caggatccatgggtgcaggtgcaagaatgcaagtgcctcctccctccaaaaagtctgaaaccgacaacatcaatcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtgcctctctactgggcctgccaagggtgcgtcctaaccggcgtctgggtcatagcccacgagtgcggccaccacgccttcagcgactac

SEQ ID NO: 4014 - DNA, 331 bp, Artificial
  Mutation in BnaA.FAD2.a introduced by TALE nuclease pair BnFAD2_T01
caggatccatgggtgcaggtggaagaatgcaagtgtctcctcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgggcctgccagggctgcgtcctaaccggcgtctgggtcatagcccacgagtgcggccaccacgccttcagcgactac

SEQ ID NO: 4015 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagcctgaaaccgacaacatcaagcgcgtaccctgcgagacaccgcccttcactctcggagaactcaagaaagcaatcccaccgcactgcttcaaacgctccatccctcgctctttctcctacctcatctgggacatcatcatagcctcctgcttctactacgtcgccaccacttacttccctctcctccctcaccctctccccgccctctaccgggcctgccaagggtgcgtcctaaccggcgtccgggtcatacccccccaatgcggccaccacggccttcggcacctc

SEQ ID NO: 4016 - DNA, 340 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccagggctgcgtcctaaccggcgtctgggtcatagcccacgagtgcggccaccacgccttcagcgactac

SEQ ID NO: 4017 - DNA, 345 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctaggcctctctactgtgcctgccagggctgcgtcctaaccggcgtctgggtcatagcccacgagtgcggccaccacgccttcagcgactac

SEQ ID NO: 4018 - DNA, 386 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggccaccacctgctggggggtcaagccgtgggcctggcacagtctctactgggcctgccagggctgcgtcctaaccggcgtctgggtcatagcccacgagtgcggccaccacgccttcagcgactac

SEQ ID NO: 4019 - DNA, 354 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttccgcctggcctctctactgggcctgccagggctgcgtcctaaccggcgtctgggtcatagcccacgagtgcggccaccacgccttcagcgactac

SEQ ID NO: 4020 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccaacttggcctctctactgggcctgccagggctgcgtcctaaccggcgtctgggtcatagcccacgagtgcggccaccacgccttcagcgactac

SEQ ID NO: 4021 - DNA, 350 bp, Artificial
  Mutation in BnaA.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgcctgcagcgactac

SEQ ID NO: 4022 - DNA, 339 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctggcctctctactgggcctgccaagggtgcgtcctaaccggcgtctgggtcatagcccacgagtgcggccgccacgccttcagcgactac

SEQ ID NO: 4023 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagcctgaaaccgacaccctcaagcgcgtaccctgcgagacaccgcccttcactgtcggagaactcaagaaagcaatcccaccgcactgcttcaaacgctccatccctcgctctttctcctacctcatctgggccatcatcatagcctcctgcctctactaccccccccccacttacctccccctcctccctccccctctcccccacctggcctctctactgggcctgccagggctgcgtcctaaccggcgtctgggtcatagcccacgagtgcggccaccacgccttcagcgactac

SEQ ID NO: 4024 - DNA, 348 bp, Artificial
  Mutation in BnaA.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaacgggcctctgggtcatagcccacgagtgcggccaccacgccttcagcgactac

SEQ ID NO: 4025 - DNA, 358 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcgggtctggcctctctactaggcctgccaagggtgcgtcctaaccggcgtctgggtcatagcccacgagtgcggccaccacgccttcagcgactac

SEQ ID NO: 4026 - DNA, 344 bp, Artificial
  Mutation in BnaA.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctctgacatcatcatagcctcctgcttctactacgtcgccaccacttacttccctctcctccctcaccctctctcctatcctctctactgggcctgccagggctgcgtcctaaccggcgtctgggtcatagcccacgagtgcggccaccacgccttcagcgactac

SEQ ID NO: 4027 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccaagggtgcgtcctaaccggcctctgggtcatagcccacgagtgcggccaccacgccttcagcgactac

SEQ ID NO: 4028 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacgacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 4029 - DNA, 347 bp, Artificial
  Mutation in BnaA.FAD2.a introduced by TALE nuclease pair BnFAD2_T01
caggatccatgggtgcaggtggcagaatgcaagtgtctcctcccttcaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 4030 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 4031 - DNA, 429 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgggcgtcctgcccgccaccctccgggccgttgcttcaccccatcgtggctggcgatggccaccacctgctccggggtcatggcctctctactgggcctgccagggctgcgtcctaaccggcgtctgggtcatagcccacgagtgcggccaccacgccttcagcgactac

SEQ ID NO: 4032 - DNA, 355 bp, Artificial
  Mutation in BnaA.FAD2.a introduced by TALE nuclease pair BnFAD2_T01
caggatccatgggtgcaggtggcagaatgcaagtgtctcttccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcgctggcctctctactgggcctgccagggctgcgtcctaaccggcgtctgggtcatagcccacgagtgcggccaccacgccttcagcgactac

SEQ ID NO: 4033 - DNA, 339 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaacatcaagcgcgtaccctgcgagacaccgcccttcactgtcggagaactcaagaaagcaatcccaccgcactgcttcaaacgctcgatccctcgctctttctcctacctcatctgggacatcatcatagcctcctgcttctactacgtcgccaccacttacttccctctcctccctcaccctctctcctacttactgggcctgccagggctgcgtcctaaccggcgtctgggtcatagcccacgagtgcggccaccacgccttcagcgactac

SEQ ID NO: 4034 - DNA, 329 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgggcctgccagggctgcgtcctaaccggcgtctgggtcatagcccacgagtgcggccaccacgccttcagcgactac

SEQ ID NO: 4035 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccagggctgcgtcctaacgggcctctgggtcatagcccacgagtgcggccaccacgccttcagcgactac

SEQ ID NO: 4036 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatccaaccgcactgtttcaaacgctcgatccctcgctctttctcctacctcatctgggacatcatcatagcctcctgcttctactacgtcgccaccacttacttccctctcctccctcaccctctctcctttcctggcctctctactgggcctgccagggctgcgtcctaaccggcgtctgggtcatagcccacgagtgcggccaccacgccttcagcgactac

SEQ ID NO: 4037 - DNA, 410 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctcctttccccgccaccctccgggccgttgcttcacaacgttcaaatccgctcccggcgaatttgtctggcctctctactgggcctgccagggctgcgtcctaactggcgtctgggtcatagcccacgagtgcggccaccacgccttcagcgactac

SEQ ID NO: 4038 - DNA, 332 bp, Artificial
  Mutation in BnaA.FAD2.a introduced by TALE nuclease pair BnFAD2_T01
caggatccatgggtgcaggtggaagaatgcaagtgtctcctccctccaaaaagactgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggaactgccaagggtgcgtcctaaccggcgtctgggtcatagcccacgagtgcggccaccacgccttcagcgactac

SEQ ID NO: 4039 - DNA, 350 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 4040 - DNA, 398 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgccaacttctcaagattgcaaaacgtggcggcgtgaccgcagtggaggcagtgcatgcgcctctctactgggcctgccagggctgcgtcctaaccggcgtctgggtcatagcccacgagtgcggccaccacgccttcagcgactac

SEQ ID NO: 4041 - DNA, 350 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttatggcctctctactgggcctgccaagggtgcgtcctaaccggcgtctgggtcatagcccacgagtgcggccaccacgccttcagcgactac

SEQ ID NO: 4042 - DNA, 339 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctactgggcctgccaagggtgcgtcctaaccggcgtctgggtcatagcccacgagtgcggccaccacgccttcagcgactac

SEQ ID NO: 4043 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcacgtaccctgcgagacaccgcccttcactgtcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 4044 - DNA, 353 bp, Artificial
  Mutation in BnaA.FAD2.a introduced by TALE nuclease pair BnFAD2_T01
caggatccatggggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggcctctctactgggcctgccagggctgcgtcctaaccggcgtctgggtcatagcccacgagtgcggccaccacgccttcagcgactac

SEQ ID NO: 4045 - DNA, 354 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgccttggcctctctactgggcctgccaagggtgcgtcctaaccggcgtctgggtcatagcccacgagtgcggccaccacgccttcagcgactac

SEQ ID NO: 4046 - DNA, 332 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccagggctgcgtcctaaccggcgtctgggtcatagcccacgagtgcggccaccacgccttcagcgactac

SEQ ID NO: 4047 - DNA, 338 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacagcactgtttcaaacgctcgatccctcgctctttctcctacctcatctgggacatcatcatagcctcctgcttctactacgtcgccaccacttacttccctctcctccctcaccctctctcctattactgggcctgccagggctgcgtcctaaccggcgtctgggtcatagcccacgagtgcggccaccacgccttcagcgactac

SEQ ID NO: 4048 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacatggcctctctactgggcctgccaagggtgcgtcctaaccggcgtctgggtcatcgcccacgaatgcggccaccacgccttcagcgactac

SEQ ID NO: 4049 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaaggctgcgtcctaacgggcctctgggtcatagcccacgagtgcggccaccacgccttcagcgactac

SEQ ID NO: 4050 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccggggctgcgtcctaaccggcgtctgggtcatagcccacgagtgcggccaccacgccttcagcgactac

SEQ ID NO: 4051 - DNA, 329 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgccaagggtgcgtcctaacgggcctctgggtcatcgcccacgaatgcggccaccacgccttcagcgactac

SEQ ID NO: 4052 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtcttggtcatagcccacgagtgcggccaccacgccttcagcgactac

SEQ ID NO: 4053 - DNA, 348 bp, Artificial
  Mutation in BnaA.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcgaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 4054 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccagggctgcgtcctaaccggcctctgggtcatcgcccacgaatgcggccaccacgccttcagcgactac

SEQ ID NO: 4055 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgattcctcgctctttctcctacctcatctgggacatcatcatagcctcctgcttctactacgtcgccaccacttacttccctctcctccctcaccctctctcctatcctctctactgggcctgccagggctgcgtcctaaccggcgtctgggtcatagcccacgagtgcggccaccacgccttcagcgactac

SEQ ID NO: 4056 - DNA, 357 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcccgcgcctggcctctctactgggcctgccagggctgcgtcctaaccggcctctgggtcatagcccacgagtgcggccaccacgccttcagcgactac

SEQ ID NO: 4057 - DNA, 352 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgccggcccctctactgggcctgccaaggctgcgtcctaacgggcctctgggtcatcgcccacgaatgcggccaccacgccttcagcgactac

SEQ ID NO: 4058 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacatacttccctctcctccctcaccctctctcctaccgcgcggcctctctactgggcctgccagggctgcgtcctaaccggcgtctgggtcatagcccacgagtgcggccaccacgccttcagcgactac

SEQ ID NO: 4059 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccccgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccagggctgcgtcctaaccggcgtctgggtcatagcccacgagtgcggccaccacgccttcagcgactac

SEQ ID NO: 4060 - DNA, 334 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcacccactctctactgggcctgccagggctgcgtcctaaccggcgtctgggtcatagcccacgagtgcggccaccacgccttcagcgactac

SEQ ID NO: 4061 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccctggcctctctactgggcctgccagggctgcgtcctaaccggcgtctgggtcatagcccacgagtgcggccaccacgccgtcagcgactac

SEQ ID NO: 4062 - DNA, 311 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatccctcgctccttctcctacctcctcttcgacatcctcgtctcctcctccctcaccctctctcctacttggcctctctactgggcctgccagggctgcgtcctaaccggcgtctgggtcatagcccacgagtgcggccaccacgccttcagcgactac

SEQ ID NO: 4063 - DNA, 344 bp, Artificial
  Mutation in BnaA.FAD2.a introduced by TALE nuclease pair BnFAD2_T01
caggatccatgggtgcaggtggaagaatgcaagtgactcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcttggcctctctactgggcctgccaagggtgcgtcctaaccggcgtctgggtcatagcccacgagtgcggccaccacgccttcagcgactac

SEQ ID NO: 4064 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccccacttctctctactgggcctgccaagggtgcgtcctaacgggcctctgggtcatagcccacgagtgcggccaccacgccttcagcgactac

SEQ ID NO: 4065 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggggaactcaagaaagcaatcccaccgcactgtctcaaacgctcgatccctccctctttctcctccctcatctgggacatcatcatagcctcctgcttctactacgccgcctcctcttacttccctctcctccctcaccctctctcagtcgactggcctctcttcgaggcctgccagggctgcgtcctaaccggcgtctgggtcatagcccacgagtgcggccaccacgcctgcagccactac

SEQ ID NO: 4066 - DNA, 352 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccatcaccctctctcctacttcgctggcctctctactgggcctgccagggctgcgtcctaaccggcgtctgggtcatagcccacgagtgcggccaccacgccttcagcgactac

SEQ ID NO: 4067 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggggcgtcctaacgggcctctgggtcatcgcccacgaatgcggccaccacgccttcagcgactac

SEQ ID NO: 4068 - DNA, 348 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 4069 - DNA, 334 bp, Artificial
  Mutation in BnaA.FAD2.a introduced by TALE nuclease pair BnFAD2_T01
caggatccatgggtgcaggtggaagaatgcaagtctctcctccctccagctcccccggaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttccttccctctcctccctcaccctctctctactgggcctgccagggctgcgtcctaaccggcgtctgggtcatagcccacgagtgcggccaccacgccttcagcgactac

SEQ ID NO: 4070 - DNA, 390 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgctggcggtggcaagcacctgctggggggtcaagccgtgggcggcctctctactgggcctgccaagggtgcgtcctaaccggcgtctgggtcatagcccacgagtgcggccaccacgccttcagcgactac

SEQ ID NO: 4071 - DNA, 417 bp, Artificial
  Mutation in BnaA.FAD2.a introduced by TALE nuclease pair BnFAD2_T01
caggatccatgggtgcaggtggcagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtcaggacatgatcgcagcgttgccagagcgagattctccgcgctgtagaagtcaccattgttgtgctggcctctctactgggcctgccagggctgcgtcctaacgggcctctgggtcatcgcccacgaaggcggccaccacgccttcagcgactac

SEQ ID NO: 4072 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccctggcctctctactgggcctgccaaggctgcgtcctaacgggcctctgggtcatagcccacgagtgcggccaccacgccttcagcgactac

SEQ ID NO: 4073 - DNA, 342 bp, Artificial
  Mutation in BnaA.FAD2.a introduced by TALE nuclease pair BnFAD2_T01
cggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgccttcagcgactac

SEQ ID NO: 4074 - DNA, 358 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgggtctggcctctctactaggcctgccagggctgcgtcctaaccggcgtctgggtcatagcccacgagtgcggccaccacgccttcagcgactac

SEQ ID NO: 4075 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctagatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 4076 - DNA, 346 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccagggctgcgtcctaaccggcgtctgggtcatagcccacgagtgcggccaccacgccttcagcgactac

SEQ ID NO: 4077 - DNA, 358 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtctgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgggtctggcctctctactgggcctgccagggctgcgtcctaaccggcgtctgggtcatagcccacgagtgcggccaccacgccttcagcgactac

SEQ ID NO: 4078 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccagggctgcgtcctaaccggcgtctgggtcatagccaacgagtgcggccaccacgccttcagcgactac

SEQ ID NO: 4079 - DNA, 344 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctcgcctggcctctctactgggcctgccagggctgcgtcctaaccggcgtctgggtcatagcccacgagtgcggccaccacgccttcagcgactac

SEQ ID NO: 4080 - DNA, 390 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgctggcgatggccaccacctgctggggggtcaagccgtgggcggcctctctactgggcctgccaagggtgcgtcctaaccggcgtctgggtcatagcccacgagtgcggccaccacgccttcagcgactac

SEQ ID NO: 4081 - DNA, 335 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccagggctgcgtcctaaccggcgtctgggtcatagcccacgagtgcggccaccacgccttcagcgactac

SEQ ID NO: 4082 - DNA, 374 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccaggcttatcttggacaagaagaagatcgctctctactgggcctgccaagggtgcgtcctaacgggcctctgggtcatagcccacgagtgcggccaccacgccttcagcgactac

SEQ ID NO: 4083 - DNA, 342 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtacgctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccctactgggcctgccagggctgcgtcctaaccggcgtctgggtcatagcccacgagtgcggccaccacgccttcagcaactac

SEQ ID NO: 4084 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccatcagcgactac

SEQ ID NO: 4085 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcatcatctcctcctccctctaccacctctccacagcctacttccctctcctcccccaccctctccctggcccctctactgggcctgccaagggtgcgtcctaaccggcgtctgggtcatagcccacgagtgcggccaccacgccttcagcgactac

SEQ ID NO: 4086 - DNA, 353 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccttggcctctctactgggcctgccagggctgcgtcctaaccggcgtctgggtcatagcccacgagtgcggccaccacgcttcagcgactac

SEQ ID NO: 4087 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccagggctgcgtcctaatcggcgtctgggtcatagcccacgagtgcggccaccacgccttcagcgactac

SEQ ID NO: 4088 - DNA, 351 bp, Artificial
  Mutation in BnaA.FAD2.a introduced by TALE nuclease pair BnFAD2_T01
caggatccatgggtgcaggtggaagaatgcaagtgtctactccctccaaaaagactgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccagggctgcgtcctaaccggcgtctgggtcatagcccacgagtgcggccaccacgccttcagcgactac

SEQ ID NO: 4089 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaacgggcctctgggtcatagcccacgagtgcggccaccacgccttcagcgactac

SEQ ID NO: 4090 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcgcctctctactgggcctgccaaggctgcgtcctaacgggcctctgggtcatagcccacgagtgcggccaccacgccttcagcgactac

SEQ ID NO: 4091 - DNA, 339 bp, Artificial
  Mutation in BnaA.FAD2.a introduced by TALE nuclease pair BnFAD2_T01
caggatccatgggtgcaggtggaagaatgcaagtgtctactccctccaagaagcctgaaaccgacaccatcaggcgcgtaccctgcgagacaccgcccttaactgtcggagaactcaagaaagcaatcccaccgcactgtttcaaacgcttgctccctcgctctttctcctacctcatctgggacatcatcatagcctcctgcttctactacgtcgccaccacttacttccctctcctccctcaccctctcgcctctctactgggcctgccagggctgcgtcctaaccggcgtctgggtcatagcccacgagtgcggccaccacgccttcagcgactac

SEQ ID NO: 4092 - DNA, 335 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccagggctgcgtcctaacgggcctctgggtcatagcccacgagtgcggccaccacgccttcagcgactac

SEQ ID NO: 4093 - DNA, 344 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccagggctgcgtcctaaccggcgtctgggtcatagcccacgagtgcggccaccacgccttcagcgactac

SEQ ID NO: 4094 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcacgcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccacctcttacttccctctcctccctcaccctctctcctactcgcctctctactgggcctgccagggctgcgtcctaaccggcgtctgggtcatagcccacgaaagcggccaccgcgccttcagcgactac

SEQ ID NO: 4095 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcggcctctctactgggcctgccagggctgcgtcctaaccggcgtctgggtcatagcccacgagtgcggccaccacgccttcagcgactac

SEQ ID NO: 4096 - DNA, 450 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactctagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgaaaacggcttgtcccgcgtcatcggcgggggtcataacgtgactcccttaaggcagtgcatgcatggcgcaatgcactgacgggtgccccgctcaactttggcctctctactgggcctgccagggctgcgtcctaaccggcgtctgggtcatagcccacgagtgcggccaccacgccttcagcgactac

SEQ ID NO: 4097 - DNA, 349 bp, Artificial
  Mutation in BnaA.FAD2.a introduced by TALE nuclease pair BnFAD2_T01
caggatccatgggtgcaggtggaagaatgcaagtggcccctcactcgaagaagcctgaaaccgacaccaacaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgccgtcgcctctctactgagcctcccagggctgcgtcctaaccggcgtctggtgcttagcccacgagtgcggccaccacgccctcagcgactac

SEQ ID NO: 4098 - DNA, 341 bp, Artificial
  Mutation in BnaA.FAD2.a introduced by TALE nuclease pair BnFAD2_T01
caggatccatgggtgcaggtggaagaatgcaagtgtcccctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttgcttccctctcctccctcaccctctctcctacttttactgagcctgccagggctgcgtcctaaccggcttctgggtcatagcccacaagtgcggccaccacgccttcagcgactac

SEQ ID NO: 4099 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcgctggcctctctactgggcctgccagggctgcgtcctaacgggcctctgggtcatcgcccacgaatgcggccaccacgccttcagcgactac

SEQ ID NO: 4100 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagagcgtaccctgcgagacaccgccattcactgtcggagaactcaagaaagcaatcccaccgcactgtttcaaacgctcgatccctcgctctttctccttcctcatctgggaaatcatcatagcctcctgcttctactacgtcgccaccacttacttccctcccctccctcaccctctctcctgccttggcctctctactgggcctgccagggctgcgtcctaaccggcgtctgggtcatagcccacgagtgcggccaccacgccttcagcgactac

SEQ ID NO: 4101 - DNA, 357 bp, Artificial
  Mutation in BnaA.FAD2.a introduced by TALE nuclease pair BnFAD2_T01
caggatccatgggtgcaggtggaagaatgcaagtgtctactcactccaagaagtctgaaaccgaaaccatcaagcgcgtaccctgcgagacaccgaccttcactgtcggagaactcaagaaagcaatcccaccgcactgtttcaaacgctcgatccctcgctctttctcctacctcatctgggacatcatcatagcctcctgcctctactacgtcgccaccacgtacttccctctcctccctcaccctcccgcctacttcgcgcgcctggcctctctactgggcctgccagggctgcgtcctaaccggcgtctgggtcatagcccacgagtgcggccaccacgccttcagcgactac

SEQ ID NO: 4102 - DNA, 352 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctactgcgctggcctctctacggggcctgccagggctgcgtcctaaccggcgtctgggtcatagcccacgagtgcggccaccacgccttcagcgactac

SEQ ID NO: 4103 - DNA, 349 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctccgctggcctctctactgggcctgccagggctgcgtcctaaccggcgtctgggtcatagcccacgagtgcggccaccacgccttcagcgactac

SEQ ID NO: 4104 - DNA, 354 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaacctacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttccgcctggcctctctactgggcctgccaagggtgcgtcctaaccggcgtctgggtcatagcccacgagtgcggccaccacgccttcagcgactac

SEQ ID NO: 4105 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcttctggcctctctactgggcctgccagggctgcgtcctaaccggcgtctgggtcatagcccacgagtgcggccaccacgccttcagcgactac

SEQ ID NO: 4106 - DNA, 386 bp, Artificial
  Mutation in BnaA.FAD2.a introduced by TALE nuclease pair BnFAD2_T01
caggatccatggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccccggagcaggtggtggccatcgccagccacgatggcgcctggcctctctactgggcctgccagggctgcgtcctaaccggcgtctgggtcatagcccacgagtgcggccaccacgccttcagcgactac

SEQ ID NO: 4107 - DNA, 357 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctccgcccgcctggcctctctactgggcctgccagggctgcgtcctaaccggcgtctgggtcatagcccacgagtgcggccaccacgccttcagcgactac

SEQ ID NO: 4108 - DNA, 349 bp, Artificial
  Mutation in BnaA.FAD2.a introduced by TALE nuclease pair BnFAD2_T01
caggatccatgggtgcaggtggaagaatgcaagtgtctcctccctccgaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctctctactgggcctgccagggctgcgtcctaaccggcgtctgggtcatagcccacgagtgcggccaccacgccttcagcgactac

SEQ ID NO: 4109 - DNA, 357 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcgcgcctggcctctctactgggcctgccagggctgcgtcctaacgggcctctgggtcatcgcccacgaatgcggccaccacgccttcagcgactac

SEQ ID NO: 4110 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgaccac

SEQ ID NO: 4111 - DNA, 345 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggcctgccagggctgcgtcctaaccggcgtctgggtcatagcccacgagtgcggccaccacgccttcagcgactac

SEQ ID NO: 4112 - DNA, 347 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaatggcctctctactgggcctgccagggctgcgtcctaaccggcgtctgggtcatagcccacgagtgcggccaccacgccttcagcgactac

SEQ ID NO: 4113 - DNA, 340 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgcccccacttacttccctctcctccctcaccctctcgcctcctttactgggcctgccagggctgcgtcctaaccggcgtctgggtcatagcccacgagtgcggccaccacgccttcagcgactac

SEQ ID NO: 4114 - DNA, 334 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccagggctgcgtcctaaccggcgtctgggtcatagcccacgagtgcggccaacacgccttcagcgactac

SEQ ID NO: 4115 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcttctgggtcatagcccacgagtgcggccaccacgccttcagcgactac

SEQ ID NO: 4116 - DNA, 343 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccagggctgcgtcctaaccggcgtctgggtcatagcccacgagtgcggccaccacgccttcagcgactac

SEQ ID NO: 4117 - DNA, 381 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgctcgccgcagccgaacgaccgagcgcagcgtggcccctctactgggcctgccaaggctgcgtcctaacgggcctctgggtcatcgcccacgaatgcggccaccacgccttcagcgactaa

SEQ ID NO: 4118 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccaagggtgcgtcctaacgggcctctgggtcatagcccacgagtgcggccaccacgccttcagcgactac

SEQ ID NO: 4119 - DNA, 352 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggccctctactgggcctgccagggctgcgtcctaaccggcctctgggtcatagcccacgagtgcggccaccacgccttcagcgactac

SEQ ID NO: 4120 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactatcggagaactcaagaaagcaatcccacctcactgtttcaaacgctcgctccctcgctctgtctcctacctcatctgggacgtcatcatagcctcctgcttctactacttcgccgcctcttacttccctctcctccctcaccctctctcctgcctagcctctatactgggccggacaagggtgcggcctaacctgcgtctgggtcatagcccacgagtgcggccaccacgccttcagcgactac

SEQ ID NO: 4121 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccagggctgcggcctaaccggcgtctgggtcatagcccacgagtgcggccaccacgccttcagcgactac

SEQ ID NO: 4122 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaaggctgcgtcctaacgggcctctgggtcatagcccacgagtgcggccaccacgccttcagcgactac

SEQ ID NO: 4123 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccagggctgcgtcctaaccggcgtctgggtcatagcccacgagtgcggccaccacgccttcagcgactac

SEQ ID NO: 4124 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctggcctctctactgggcctgccagggctgcgtcctaaccggcgtctgggtcatagcccacgagtgcggccaccacgccttcagcgactac

SEQ ID NO: 4125 - DNA, 338 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattactgggcctgccagggctgcgtcctaaccggcgtctgggtcatagcccacgagtgcggccaccacgccttcagcgactac

SEQ ID NO: 4126 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 4127 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 4128 - DNA, 341 bp, Artificial
  Mutation in BnaA.FAD2.a introduced by TALE nuclease pair BnFAD2_T01
caggatccatgggtgcaggtggcagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgggcctgccagggctgcgtcctaaccggcgtctgggtcatagcccacgagtgcggccaccacgccttcagcgactac

SEQ ID NO: 4129 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcctggcctctctactgggcctgccagggctgcgtcctaaccggcgtctgggtcatagcccacgagtgcggccaccacgccttcagcgactac

SEQ ID NO: 4130 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcctcccccaccctctcccttacctctggcccctctactgggcctgccaaggctgcgtcctaaccggcgtctgggtcatagcccacgagtgcggccaccacgccttcagcgactac

SEQ ID NO: 4131 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgctggcctctctactgggcctgccagggctgcgtcctaaccggcgtctgggtcatcgcccacgaatgcggccaccacgccttcagcgactac

SEQ ID NO: 4132 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccagggctgcgtcctaaccggcgtctgggtcatagccacgagtgcggccaccacgccttcagcgactac

SEQ ID NO: 4133 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctatcctctctactgggcctgccagggctgcgtcctaacgggcctctgggtcatagcccacgagtgcggccaccacgccttcagcgactac

SEQ ID NO: 4134 - DNA, 338 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccctctctactgggcctgccaagggtgcgtcctaaccggcgtctgggtcatagcccacgagtgcggccaccacgccttcagcgactac

SEQ ID NO: 4135 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccagggctgcgtcctaacgggcctctgggtcatagcccacgagtgcggccaccacgccttcagcgactac

SEQ ID NO: 4136 - DNA, 357 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtccccaccacttacttccctctcctccctcaccctctcccctcctccccccgcctggcctctctactgggcctgccaagggtgcgtcctaaccggcgtctgggtcatagcccacgagtgcggccaccacgccttcagcgactac

SEQ ID NO: 4137 - DNA, 347 bp, Artificial
  Mutation in BnaA.FAD2.a introduced by TALE nuclease pair BnFAD2_T01
caggatccatgggtgcaggtggaagaatgcaagtctctcctccctccagctcccccggaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctcctcgcctctctactgggcctgccagggctgcgtcctaaccggcgtctgggtcatagcccacgagtgcggccaccacgccttcagcgactac

SEQ ID NO: 4138 - DNA, 386 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcccccggagcaggtggtggccatcgccagccacgatggcgcctggcctctctactgggcctgccagggctgcgtcctaaccggcgtctgggtcatagcccacgagtgcggccaccacgccttcagcgacac

SEQ ID NO: 4139 - DNA, 339 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttactgggcctgccagggctgcgtcctagccggcgtctgggtcatagcccacgagtgcggccaccacgccttcagcgactac

SEQ ID NO: 4140 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcccggcctctctactgggcctgccaaggctgcgtcctaacgggcctctgggtcatagcccacgagtgcggccaccacgccttcagcgactac

SEQ ID NO: 4141 - DNA, 342 bp, Artificial
  Mutation in BnaA.FAD2.a introduced by TALE nuclease pair BnFAD2_T01
caggatccatgggtgcaggtggaagaatgcaagtgtctcctcactccaaaaagactgaaaccgacaacatcaagcgcgtaccctgcgagacaccgcccttcactgtcggagaactcaagaaagcaatcccactgcactgtttcaaacgctcgatccctcgctctttctcctacctcatctgggacatcatcatagccacctgcttctactacgtcgccaccacttacttccctctcctccctcaccctctctctgtctctctactgggcctgccaggggtgcgtcctaaccggcgtctgggtcatagcccacgagtgcggccaccacgccttcagcgactac

SEQ ID NO: 4142 - DNA, 332 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccagggctgcgtcctaaccggcgtctgggtcatagcccacgagggcggccaccacgccttcagcgactac

SEQ ID NO: 4143 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctacggggcctgccaagggtgcgtcctaaccggcgtctgggtcatagcccacgagtgcggccaccacgccttcagcgactac

SEQ ID NO: 4144 - DNA, 300 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtctctctactgggtctgccaagggtgcgtcctaaccggcgtctgggtcatagcccacgagtgcggccaccacgccttcagcgactac

SEQ ID NO: 4145 - DNA, 455 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctcctccgctggcccgtctccagcgccggcttgccgccagcgtggctggcgagggcccccacctgctccggggtcaagccgtgggcctggcacagcaccggcaacagccgcttggcctctctactgggcctgccagggctgcgtcctaaccggcgtctgggtcatagcccacgagtgcggccaccacgccttcagcgactac

SEQ ID NO: 4146 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaacgggcctctgggtcatcgcccacgaatgcggccaccacgccttcagcgactac

SEQ ID NO: 4147 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccttggcctctctactgggcctgccagggctgcgtcctaaccggcgtctgggtcatagcccacgagtgcggccaccacgccttcagcgactac

SEQ ID NO: 4148 - DNA, 354 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcatacctcatctgggacatcatcatagcctcctgcttctactacgtcgccaccacttacttccctctcctccctcaccctctctcctacttcgtggtggcctctctactgggcctgccaagggtgcgtcctaaccggcgtctgggtcatagcccacgagtgcggccaccacgccttcagcgactac

SEQ ID NO: 4149 - DNA, 343 bp, Artificial
  Mutation in BnaA.FAD2.a introduced by TALE nuclease pair BnFAD2_T01
caggatccatgggtgcaggtggaagaatgcaagtgtctccttcctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccagggctgcgtcctaaccggcgtctgggtcatagcccacgagtgcggccaccacgccttcagcgactac

SEQ ID NO: 4150 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccaaggctgcgtcctaacgggcctctgggtcatagcccacgagtgcggccaccacgccttcagcgactac

SEQ ID NO: 4151 - DNA, 351 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctactgcctggcctctctactgggcctgccagggctgcgtcctaaccggcgtctgggtcatagcccacgagtgcggccaccacgccttcagcgactac

SEQ ID NO: 4152 - DNA, 335 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccagggctgcgtcctaaccggcgtctgggtcatagcccacgagtgcggccaccacgccttcagcgactac

SEQ ID NO: 4153 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgagcctgccagggctgcgtcctaaccggcgtctgggtcatagcccacgagtgcggccaccacgccttcagcgactac

SEQ ID NO: 4154 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacatggcctctctactgggcctgccaagggtgcgtcctaaccggcgtctggggcatagcccacgagtgcggccaccacgccttcagcgactac

SEQ ID NO: 4155 - DNA, 348 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttggcctctctactgggcctcccagggctgcgtcctgaccggcgtctgggtcatagcccacgagtgcggccaccacgccttcagcgactac

SEQ ID NO: 4156 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaacgggcctctgggtcatagcccacgagtgcggccaccacgccttcagcgactac

SEQ ID NO: 4157 - DNA, 345 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccagggctgcgtcctaaccggcgtctgggtcatagcccacgagggcggccaccacgccttcagcgactac

SEQ ID NO: 4158 - DNA, 351 bp, Artificial
  Mutation in BnaA.FAD2.a introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccagggctgcgtcctaaccggcgtctgggtcatagcccacgagtgcggccaccacgccttcagcgactac

SEQ ID NO: 4159 - DNA, 346 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacggcctctctactgggcctgccagggctgcgtcctaaccggcgtctgggtcatagcccacgagtgcggccaccacgccttcagcgactac

SEQ ID NO: 4160 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 4161 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgctggcctctctactgggcctgccaagggtgcgtcctaaccggcgtctgggtcatagcccacgagtgcggccaccacgccttcagcgactac

SEQ ID NO: 4162 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcgagcgcgtaccctgcgagacaccgcccttcactgtcggagaactcaagaaagcaatcccaccgcactgtttcaaacgctcgatccctcgctctttctcctacctcatctggcacatcatcatagcctcctgcttctactacgtcgccaccacttacttccctctcctccctcaccctctctcctactggcctctctactgggcctgccaagggtgtgtcctaaccggcgtctgggtcatagcccacgagtgcggccaccacgccttcagcgactac

SEQ ID NO: 4163 - DNA, 356 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctccttcgccgcctggcctctctactgggcctgccaagggtgcgtcctaaccggcgtctgggtcatagcccacgagtgcggccaccacgccttcagcgactac

SEQ ID NO: 4164 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcatccctcaccctctctcctacttggcctctctactgggcctgccaagggtgcgtcctaaccggcgtctgggtcatagcccacgagtgcggccaccacgccttcagcgactac

SEQ ID NO: 4165 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcgcagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 4166 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcctctctactgggcctgccagggctgcgtcctaaccggcgtctgggtcatagcccacgagtgcggccaccacgccttcagcgactac

SEQ ID NO: 4167 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctccttcctcaccctctctcctactggcctctctactgggcctgccagggctgcgtcctaaccggcgtctgggtcatagcccacgagtgcggccaccacgccttcagcgactac

SEQ ID NO: 4168 - DNA, 347 bp, Artificial
  Mutation in BnaA.FAD2.a introduced by TALE nuclease pair BnFAD2_T01
caggatccagggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctagccggcgtctgggtcatagcccacgagtgcggccaccacgcctgcagcgactac

SEQ ID NO: 4169 - DNA, 338 bp, Artificial
  Mutation in BnaA.FAD2.a introduced by TALE nuclease pair BnFAD2_T01
caggatccatgggtgcaggtggaagaatgcaagtgtctcctccctccaaaaagcctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctctctactgggcctgccaagggtgcgtcctaaccggcgtctgggtcatagcccacgagtgcggccaccacgccttcagcgactac

SEQ ID NO: 4170 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctcttcgacatcatcatagcctcctgcttctactacgtcgccaccccttacttccctctcctccctcaccctctctcctacttggcctctctactgggcctgccagggctgcgtcctaaccggcgtctgggtcatagcccacgagtgcggccaccacgccttcagcgactac

SEQ ID NO: 4171 - DNA, 348 bp, Artificial
  Mutation in BnaA.FAD2.a introduced by TALE nuclease pair BnFAD2_T01
caggatccatgggtgcaggtggaagaatgcaagtctatcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggcggcgtcctaaccggcgtctgggtcatagcccacgagtgcggccaccacgccttcagcgactac

SEQ ID NO: 4172 - DNA, 354 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttccctcgccctggcccctctactgggcctgccaaggctgcgtcctaacgggcctctgggtcatcgcccacgaatgcggccaccacgccttcagcgactac

SEQ ID NO: 4173 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccccccccggcctctctaccgggcctgccagggctgcgtcctaaccggcgtctgggtcatagcccacgagtgcggccaccacgccttcagcgactac

SEQ ID NO: 4174 - DNA, 347 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccagggctgcgtcctaaccggcgtctgggtcatagcccacgagtgcggccaccacgccttcagcgactac

SEQ ID NO: 4175 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttctggcctctctactgggcctgccagggctgcgtcctaacgggcctctgggtcatagcccacgagtgcggccaccacgccttcagcgactac

SEQ ID NO: 4176 - DNA, 349 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctccatcccacgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 4177 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgtggcctctctactgggcctgccagggctgcgtcctaaccggggtctgggtcatagcccacgagtgcggccaccacgccttcagcgactac

SEQ ID NO: 4178 - DNA, 339 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccggcctgccagggctgcgtcctaaccggcgtctgggtcatcgcccacgaatgcggccaccacgcctgcagcgactac

SEQ ID NO: 4179 - DNA, 349 bp, Artificial
  Mutation in BnaA.FAD2.a introduced by TALE nuclease pair BnFAD2_T01
caggatccatgggtgcaggtggaagaatgcaagtctctcctccctccaacacgcccgaaaccgacaccctcaagcgcgtaccctgcgagacaccgcccttcactgtcggagaactcaagaaagcaatcccaccacactgtttcaaacgctcgatccctcgctctttctcctacctcatctcggacaccatcataccctcctcctctcaccccctcgcccccacttactttcctcctctccctctccctctctcctccctcggcctctctactgggcctgccagggctgcgtcctaaccggcgtctgggtcatagcccacgagtgcggccaccacgccttcagcgactac

SEQ ID NO: 4180 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcctctgggtcatagcccacgagtgcggccaccacgccttcagcgactac

SEQ ID NO: 4181 - DNA, 471 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctccttgctttgttataatgccaactttgtacaaaaaagcaggcttaggtacctcgcgaatgcatctagatccaatgatcatgagcggagaatgggcctggcacagcaccggcaacagccgctggacctggcctctctactgggcctgccagggctgcgtcctaaccggcgtctgggtcatagcccacgagtgcggccaccacgccttcagcgactac

SEQ ID NO: 4182 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctgcttggcctctctactgggcctgccaagggtgcgtcctaaccggcgtctgggtcatagcccacgagtgcggccaccacgccttcagcgactac

SEQ ID NO: 4183 - DNA, 450 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgaaaccggcttgtcccgcgtcatcggcgggggtcataacgtgactcccttaaggcagtgcatgcatggcgcaatgcactgacgggtgccccgctcaacttcggcctctctactgggcctgccagggctgcgtcctaaccggcgtctgggtcatagcccacgagtgcggccaccacgccttcagcgactac

SEQ ID NO: 4184 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagcctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcgtccaccacgccttcagcgactac

SEQ ID NO: 4185 - DNA, 325 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctgcgtcctaaccggcgtctgggtcatagcccacgagtgcggccaccacgccttcagcgactac

SEQ ID NO: 4186 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgagtgcggccacaacgccttcagcgactac

SEQ ID NO: 4187 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctacttggcctgccagggctgcgtcctaaccggcgtctgggtcatagcccacgagtgcggccaccacgccttcagcgactac

SEQ ID NO: 4188 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccccctggcctctctactgggcctgccagggctgcgtcctaaccggcgtctgggtcatagcccacgagtgcggccaccacgccttcagcgactac

SEQ ID NO: 4189 - DNA, 357 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcccgcctggcctctctactgggcctgccagggctgcgtcctaaccggcgtctgggtcatagcccacgagtgcggccaccacgccttcagcgactac

SEQ ID NO: 4190 - DNA, 339 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggaaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctactgggcctgccagggctgcgtcctaaccggcgtctgggtcatagcccacgagtgcggccaccacgccttcagcgactac

SEQ ID NO: 4191 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccaaggctgcgtcctaacgggcctctgggtcatcgcccacgaatgcggccaccacgccatcagcgactac

SEQ ID NO: 4192 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggcctgccagggctgcgtcctaaccggcgtcttggtcatagcccacgagtgcggccaccacgccttcagcgactac

SEQ ID NO: 4193 - DNA, 356 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgacgcctggcctctctactgggcctgccaagggtgcgtcctaaccggcgtcggggtcatagcccacgagtgcggccaccacgccttcagcgactac

SEQ ID NO: 4194 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgccctttctcctacctcatctgggacatcatcatagcctcctgcttctactacgtcgccaccacttacttccctctcctccctcaccctctctcctacttcgcgcctggcctctctactgggcctgccagggctgcgtcctaaccggcgtctgggtcatagcccacgagtgcgaccaccacgccttcagcgactac

SEQ ID NO: 4195 - DNA, 354 bp, Artificial
  Mutation in BnaA.FAD2.a introduced by TALE nuclease pair BnFAD2_T01
caggatccatgggtgcaggtgcaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccttggcctctctactgggcctgccagggctgcgtcctaaccggcgtctgggtcatagcccacgagtgcggccaccacgccttcagcgactac

SEQ ID NO: 4196 - DNA, 348 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcataacctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 4197 - DNA, 350 bp, Artificial
  Mutation in BnaA.FAD2.a introduced by TALE nuclease pair BnFAD2_T01
caaggatccatgggtgcaggtggaagaatgcaagtctctcctccctccagctcccccggaaccaacaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 4198 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgcttcaaacgctccatcccacgctccttctcctcttcgacatcatcatctcctcctcggctcctccctctaccaccactccacagcctacttccctctcctccctcaccctctctcctacttggcctctctactgggcctgccagggctgcggcctaaccggcgtctgggtcatagcccacgagtgcggccaccacgccttcagcgactac

SEQ ID NO: 4199 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcacaaccacttacttccctctcctccctcaccctctctccctggcctctctactgggcctgccagggctgcgtcctaaccggcgtctgggtcatagcccacgagtgcggccaccacgccttcagcgactac

SEQ ID NO: 4200 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcataacctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 4201 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccggcctctctactgggcctgccagggctgcgtcctaacgggcctctgggtcatagcccacgagtgcggccaccacgccttcagcgactac

SEQ ID NO: 4202 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccatcaccctctctcctacttctggcctctctactgggcctgccagggctgcgtcctaaccggcgtctgggtcatagcccacgagtgcggccaccacgccttcagcgactac

SEQ ID NO: 4203 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctttggcgctggcctctctactgggcctgccagggctgcgtcctaaccggcgtctgggtcatagcccacgagtgcggccaccacgccttcagcgactac

SEQ ID NO: 4204 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccccgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttccctcggcccctctactgggcctgccaaggctgcgtcctaacgggcctctgggtcatcgcccacgaatgcggccaccacgccttcagcgactac

SEQ ID NO: 4205 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgcctccacttacttccctctcctccctcaccctctctcctaggcctctctactgggcctgccagggctgcgtcctaaccggcgtctgggtcatagcccacgagtgcggccaccacgccttcagcgactac

SEQ ID NO: 4206 - DNA, 345 bp, Artificial
  Mutation in BnaA.FAD2.a introduced by TALE nuclease pair BnFAD2_T01
caggatccatgggtgcaggtgtaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccagggctgcgtcctaaccggcgtctgggtcatagcccacgagtgcggccaccacgccttcagcgactac

SEQ ID NO: 4207 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaactggcgtctgggtcatagcccacgagtgcggccaccacgccttcagcgactac

SEQ ID NO: 4208 - DNA, 345 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcggctctctactgggcctgccaagggtgcgtcctaaccggcgtctgggtcatagcccacgagtgcggccaccacgccttcagcgactac

SEQ ID NO: 4209 - DNA, 346 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctccgacttcctctctactgggcctgccagggctgcgtcctaaccggcgtctgggtcatagcccacgagtgcggccaccacgccttcagcaactac

SEQ ID NO: 4210 - DNA, 350 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 4211 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgctagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtcctctctactgggcctgccagggctgcgtcctaacgggcctctgggtcatcgcccacgaatgcggccaccacgccttcagcgactac

SEQ ID NO: 4212 - DNA, 338 bp, Artificial
  Mutation in BnaA.FAD2.a introduced by TALE nuclease pair BnFAD2_T01
caggagccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattactgggcctgccagggctgcgtcctaaccggcgtctgggtcatagcccacgagtgcggccaccacgccttcagcgactac

SEQ ID NO: 4213 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccccggcctctctactgggcctgccagggctgcgtcctaaccggcgtctgggtcatagcccacgagttcggccaccacgccttcagcgactac

SEQ ID NO: 4214 - DNA, 332 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctacggggcctgccagggctgcgtcctaaccggcgtctgggtcatagcccacgagtgcggccaccacgccttcagcgactac

SEQ ID NO: 4215 - DNA, 347 bp, Artificial
  Mutation in BnaA.FAD2.a introduced by TALE nuclease pair BnFAD2_T01
caggatccattggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccagggctgcgtcctaaccggcgtctgggtcatagcccacgagtgcggccaccacgccttcagcgactac

SEQ ID NO: 4216 - DNA, 335 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttagccttccagggctgcgtcctaaccggcgtctgggtcatagcccacgagtgcggccaccacgccttcagcaactac

SEQ ID NO: 4217 - DNA, 345 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctaggcctctctactgggcctgccagggctgcgtcctaaccggcgtctgggtcatagcccacgagtgcggccaccacgccttcagcgactac

SEQ ID NO: 4218 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttgcctctctactgggcctgccagggctgcgtcctaaccggcgtctgggtcatagcccacgagtgcggccaccacgccttcagcgactac

SEQ ID NO: 4219 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccagggctgcgtcctaaccggcgtctgggtcatagcccacgagtgcggccaccacgccttcagcgactac

SEQ ID NO: 4220 - DNA, 343 bp, Artificial
  Mutation in BnaA.FAD2.a introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacctctctactgggcctgccagggctgcgtcctaaccggcgtctgggtcatagcccacgagtgcggccaccacgccttcagcgactac

SEQ ID NO: 4221 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcaccaccacttacttccctctcctccctcaccctctctcctacggcctctctactgggcctgccagggctgcgtcctaaccggcgtctgggtcatagcccacgagtgcggccaccacgccttcagcgactac

SEQ ID NO: 4222 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaacgggcctctgggtcatcgcccacgaatgcggccaccacgccttcagcgactac

SEQ ID NO: 4223 - DNA, 312 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcacgtaccctgcgagacaccaccattcactctcggagacctcaagaaagcaatcccacctcactgcttcaaacgctccatcccacgctccttctcctcttcgacatcatcatctcctcctcggctcctccctcaccctctctcctacttggcctctctactgggcctgccagggctgcgtcctaaccggcgtctgggtcatagcccacgagtgcggccaccacgccttcagcgactac

SEQ ID NO: 4224 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcatgcttctactacgtcgccaccacttacttccctctcctccctcaccctctctcctggcctctctactgggcctgccagggctgcgtcctaaccggcgtctgggtcatagcccacgagtgcggccaccacgccttcagcgactac

SEQ ID NO: 4225 - DNA, 337 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctactgggcctgccaagggtgcgtcctaaccggcgtctgggtcatagcccacgtgtgcggccaccgcgccttcaacgactac

SEQ ID NO: 4226 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtccgaaaccgacaccatcaagcgcgtaccctgcgagacaccgcccttcactgtcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcttggcctctctactgggcctgccagggctgcgtcctaaccggcgtctgggtcatagcccacgagtgcggccaccacgccttcagcgactac

SEQ ID NO: 4227 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctctctcctacctcatctgggacatcatcatagcctcctgcttctactacgtcgccaccacttacttccctctcctccctcaccctctctcctacttctggcctctctactgggcctgccaagggtgcgtcctaacgggcctctgggtcatagcccacgagtgcggccaccacgccttcagcgactac

SEQ ID NO: 4228 - DNA, 350 bp, Artificial
  Mutation in BnaA.FAD2.a introduced by TALE nuclease pair BnFAD2_T01
caggatcaatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctccatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 4229 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcggcctctctactgggcctgccaagggtgcgtcctaaccggcgtctgggtcatcgcccacgaatgcggccaccacgccttcagcgactac

SEQ ID NO: 4230 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatccgggacatcatcatagcctcctgcttctactacgtcgccaccacttacttccctctcctccctcaccctctctcctttcctggcctctctactgggcctgccagggctgcgtcctaaccggcgtctgggtcatagcccacgagtgcggccaccacgccttcagcgactac

SEQ ID NO: 4231 - DNA, 414 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgccggcaaaatcgcgccgaaggatgtcgctgccgactgggcaatggagcgcctgccggcccacctggcctctctactgggcctgccagggctgcgtcctaaccggcgtctgggtcatagcccacgagtgcggccaccacgccttcagcgactac

SEQ ID NO: 4232 - DNA, 338 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattactgggcctgccagggctgcgtcctaaccggcgtctgggtcatcgcccacgaatgcggccaccacgccttcagcgactac

SEQ ID NO: 4233 - DNA, 349 bp, Artificial
  Mutation in BnaA.FAD2.a introduced by TALE nuclease pair BnFAD2_T01
caggatccatgggtgcaggtgaaagaatgcaagtgtctcctccctccaaaaagtctgaaaccgacaacatcaagcgcgtaccctgcgagacaccgcccttcactgtcggagaactcaagaaagcaatcccaccacactgtttcaaacgctcgatccctcgctctttctcctacctcatctgggacatcatcatagcctcctgcttctactacgtcgccaccacttacttccctctcctccctcaccctctcgcctacgttggcctctctactgggcctgccaagggtgcgtccgaaccggcgtcggggtcatagcccgcgaatgctgcgaccacgccatgagcaactac

SEQ ID NO: 4234 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactacctggcctctctactgggcctgccaagggtccgtcctaaccggcgtctgggtcatagcccacgagtgcggccaccacgccttcagcgactac

SEQ ID NO: 4235 - DNA, 350 bp, Artificial
  Mutation in BnaA.FAD2.a introduced by TALE nuclease pair BnFAD2_T01
caggatccatgggtgcaggtggaagaatgcaagtgtctcctccctacagctcccccggaaccaacaccctcaaacgcgtcccctgcgagacaccacccttcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgacttcagcgactac

SEQ ID NO: 4236 - DNA, 439 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggtccagcgcctgcttgccgccatcgtggctggcgatggccaccacctgctccggggtcaagccgtgggcctggcacagcaccggcaagcaggcgctgtctctactgggcctgccagggctgcgtcctaaccggcgtctgggtcatagcccacgagtgcggccaccacgccttcagcgactac

SEQ ID NO: 4237 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgctggcctctctactgggcctgccagggctgcgtcctaaccggcgtctgggtcatagcccacgagtgcggccaccacgccttcagcgactac

SEQ ID NO: 4238 - DNA, 350 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaacgggcctctgggtcatcgcccacgaatgcggccaccacgccttcagcgactac

SEQ ID NO: 4239 - DNA, 349 bp, Artificial
  Mutation in BnaA.FAD2.a introduced by TALE nuclease pair BnFAD2_T01
caggatccattggtgcaggtggaagaatgcaagtgtctcctccctccaaaaagtcttaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 4240 - DNA, 339 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacacgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctactgggcctgccagggctgcgtcctaaccggcgtctgggtcatagcccacgagtgcggccaccacgccttcagcgactac

SEQ ID NO: 4241 - DNA, 349 bp, Artificial
  Mutation in BnaA.FAD2.a introduced by TALE nuclease pair BnFAD2_T01
caggatccatgggtgcaggtagaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcccttggcctctctactgggcctgccaagggtgcgtcctaaccggcgtctgggtcatagcccacgagtgcggccaccacgccttcagcgactac

SEQ ID NO: 4242 - DNA, 342 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctgcctctctactgggcctgccaagggtgcgtcctaaccggcgtctgggtcatagcccacgagtgcggccaccacgccttcagcgactac

SEQ ID NO: 4243 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctaatacgtcgccaccacttacttccctctcctccctcaccctctctcctacttccctctctactgggcctgccagggctgcgtcctaaccggcgtctgggtcatcgcccacgaattcggccaccacgccatcagcgactac

SEQ ID NO: 4244 - DNA, 342 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctctctactgggcctgccagggctgcgtcctaaccggcgtctgggtcatagcccacgagtgcggccaccacgccttcagcgactac

SEQ ID NO: 4245 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccagggctgcgtcctaaccggcgtctgggtcatagcccacgagtgcggccaccacgccttcagcgactac

SEQ ID NO: 4246 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgtgcctgccagggctgcgtcctaaccggcgtctggatcatagcccacgagtgcggccaccacgccttcagcgactac

SEQ ID NO: 4247 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcccaaccggcgtctgggtcatagcccacgagtgcggccaccacgccttcagcgactac

SEQ ID NO: 4248 - DNA, 349 bp, Artificial
  Mutation in BnaA.FAD2.a introduced by TALE nuclease pair BnFAD2_T01
caggatccatgggtgcaggtggaagaatgcaagtgtatcctccttccaaaaagtctgaaaccgacaaaatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccatcaccctctctcctcctttggcctctctactgggcctgccaagcgtgcgtcctaacggccctctgggtcatagcccaccagtgcggccacctcgccttcagcgactcc

SEQ ID NO: 4249 - DNA, 349 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccagggctgcgtcctaaccggcgtctgggtcatagcccacgagtgcggccaccacgccttcagcgactac

SEQ ID NO: 4250 - DNA, 349 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 4251 - DNA, 348 bp, Artificial
  Mutation in BnaA.FAD2.a introduced by TALE nuclease pair BnFAD2_T01
caggatccatgggtgcaggtggaagaatgcaagtgtatcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 4252 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctgcctcatctgggacatcatcatagcctcctgcttctactacgtcgccaccacttacttccctctcctccctcaccctctctcctactgggcctgccaagggtgcgtcctaaccggcgtctgggtcatagcccacgagtgcggccaccacgccttcagcgactac

SEQ ID NO: 4253 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctgccaaggctgcgtcctaacgggcctctgggtcatagcccacgagtgcggccaccacgccttcagcgactac

SEQ ID NO: 4254 - DNA, 334 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaaactcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcacccactctctactgggcctgccagggctgcgtcctaaccggcgtctgggtcatagcccacgagtgcggccaccacgccttcagcgactac

SEQ ID NO: 4255 - DNA, 323 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctcgagccacccactgggcctgccaagggtgcgtcctaaccgtcgtctgggtcatagcccacgagtgcggccaccacgccttcagcgactac

SEQ ID NO: 4256 - DNA, 351 bp, Artificial
  Mutation in BnaA.FAD2.a introduced by TALE nuclease pair BnFAD2_T01
caggatccatggggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 4257 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcattgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 4258 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccccctctcctactgggcctgccagggctgcgtcctaaccggcgtctgggtcatagcccacgagtgcggccaccacgccttcagcgactac

SEQ ID NO: 4259 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacctcaagcgcgtaccctgcgagacaccgcccttcactgtcggagaactcaagaaagcaatcccaccgcactgtttcaaacgctcgatcgctcgctctttctcctacctcatctgggacatcatcatagcctcctgcttctactacgtcgccaccacttacttccctctcctccctcaccccctctcctcctcccctggcctctctactgggcctgccaagggtgcgtcctaaccggcgtctgggtcatagcccacgagtgcggccaccacgccttcagcgactac

SEQ ID NO: 4260 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcttggcctctctactgggcctgccagggctgcgtcctaaccggcgtctgggtcatagcccacgagtgcggccaccacgccttcagcgactac

SEQ ID NO: 4261 - DNA, 342 bp, Artificial
  Mutation in BnaA.FAD2.a introduced by TALE nuclease pair BnFAD2_T01
caggatccatgagtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttctactgggcctgccagggctgcgtcctaaccggcgtctgggtcatagcccacgagtgcggccaccacgccttcagcgactac

SEQ ID NO: 4262 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcccggcctctctactgggcctgccagggctgcgtcctaaccggcgtctgggtcatagcccacgagtgcggccaccacgccttcagcgactac

SEQ ID NO: 4263 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccccttacttccctctcctccctctccctctctccgcctggcctctctactgggcctgccaaggctgcgtcctaacgggcctctgggtcatcgcccacgaatgcggccaccacgccttcagcgactac

SEQ ID NO: 4264 - DNA, 332 bp, Artificial
  Mutation in BnaA.FAD2.a introduced by TALE nuclease pair BnFAD2_T01
caggatccatgggtgcagggggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcagcctctctactgggcctgccaagggtgcgtcctaaccggcgtctgggtcatagcccacgagtgcggccaccacgccttcagcgactac

SEQ ID NO: 4265 - DNA, 347 bp, Artificial
  Mutation in BnaA.FAD2.a introduced by TALE nuclease pair BnFAD2_T01
caggatctgggtgcaggtggaagaatgcgagtgtcgcctccctccaaaaagtctgaaaccaacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctccaggccctgccaagggcgcgtcctaaccggcgtctgcctcatagcccacgagtgcggcccccacgccttcagcgactac

SEQ ID NO: 4266 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactctcggagacctcaagaaagcaatcccaccgcactgtttcaaacgctcgatccctcgctctttctcctacctcatctgggacatcatcatagcctcctgtttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 4267 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccatctctcctacggcctctctactgggcctgccaagggtgcgtcctaaccggcgtctgggtcatagcccacgagtgcggccaccacgccttcagcgactac

SEQ ID NO: 4268 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgaggcctctctactgggcctgccaagggtgcgtcctaaccggcgtctgggtcatagcccacgagtgcggccaccacgccttcagcgactac

SEQ ID NO: 4269 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtcttggtcatagcccacgagtgcggccaccacgccttcagcgactac

SEQ ID NO: 4270 - DNA, 358 bp, Artificial
  Mutation in BnaA.FAD2.a introduced by TALE nuclease pair BnFAD2_T01
caggatccatgggtgcaggtgcaagaatgcaagtgcctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgggtctggcctctctactgggcctgccaagggtgcgtcctaaccggcgtctgggtcatagcccacgattgcggccaccacgccttcagcgactac

SEQ ID NO: 4271 - DNA, 331 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcatctgggacatcatcatagcctcctgcttctactacgtcgccaccacttacttccctctcctccctcaccctctctccgggcctgccagggctgcgtcctaacgggcctctgggtcatagcccacgagtgcggccaccacgccttcagcgactac

SEQ ID NO: 4272 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgcttcaaacgctccatccctcgctctttctcctacctcatctgggacatcatcatagcctcctgcttctactacgtcgccaccacttacttccctctcctccctcaccctctctcctaggcctctctactgggcctgccagggctgcgtcctaacgggcctctgggtcatcgcccacgaatgcggccaccacgccttcagcgactac

SEQ ID NO: 4273 - DNA, 342 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccaagggtgcgtcctaaccggcgtctgggtcagagcccacgagtgcggccaccacgccttcagcgactac

SEQ ID NO: 4274 - DNA, 342 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttctactgggcctgccagggctgcgtcctaaccggcgtctgggtcatagcccacgagtgcggccaccacgccttcagcgactac

SEQ ID NO: 4275 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccaagggtgcgtcctaacgggcctctgggtcatagcccacgagtgcggccaccacgccttcagcgactac

SEQ ID NO: 4276 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttctctactgggcctgccagggctgcgtcctaaccggcgtctggggcatagcccacgagtgcggccaccacgccttcagcgactac

SEQ ID NO: 4277 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgacac

SEQ ID NO: 4278 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctggaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccagggctgcgtcctaaccggcgtctgggtcatagcccacgagtgcggccaccacgccttcagcgactac

SEQ ID NO: 4279 - DNA, 356 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctacggggcctgccaagggtgcgtcctaaccggcgtctgggtcatagcccacgagtgcggccaccacgccttcagcgactac

SEQ ID NO: 4280 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttctggcctctctactgggcctgccagggctgcgtcctaaccggcgtctgggtcatagcccacgagtgcggccaccacgccttcagcgactac

SEQ ID NO: 4281 - DNA, 330 bp, Artificial
  Mutation in BnaA.FAD2.a introduced by TALE nuclease pair BnFAD2_T01
cagggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatcttggacatcatcatagcctcctgcttctactacgtcgccaccacttacttccctctcctccctcaccctctctgggcctgccagggctgcgtcctaaccggcgtctgggtcatagcccacgagtgcggccaccacgccttcagcgactac

SEQ ID NO: 4282 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaacgcaatcccaccgcactgtttcaaacgctcgatccctcgctctttctcctacctcatctgggacatcatcatagcctcctgcttctactacgtcgccaccacttacttccctctcctccctcaccctctctcctacttggccgctctactgggcctgccagggctgcgtcctaaccggcgtctgggtcatagcccacgagtgcggccaccacgccttcagcgactac

SEQ ID NO: 4283 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccggggctgcgtcctaaccggcgtctgggtcatagcccacgagtgcggccaccacgccttcagcgactac

SEQ ID NO: 4284 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaactggcgtctgggtcatagcccacgagtgcggccaccacgccttcagcgactac

SEQ ID NO: 4285 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcgcgcctggcctctctactgggcctgccaagggtgcgtcctaaccggcgtctgggtcatagcccacgagtgcggccaccacgccttcagcgactac

SEQ ID NO: 4286 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccacctcttacttccctctcctccctcaccctctctcctacttggcctctctactgggcctgccagggctgcgtcctaaccggcgtctgggtcatagcccacgagtgcggccaccacgccttcagcgactac

SEQ ID NO: 4287 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgctaccacttacttccctcccctccctctccctcccccctacctctctactgggcctgccaaggctgcgtcctaacgggcctctgggtcatcgcccacgaatgcggccacaacgccttcagcgactac

SEQ ID NO: 4288 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccaacttggcctctctactgggcctgccaagggtgcgtcctaaccggcgtctgggtcataaaccaccagtgcggccaccacgccttcatcgactac

SEQ ID NO: 4289 - DNA, 342 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccatggctgcgtcctaaccggcgtctgggtcatagcccacgagtgcggccaccacgccttcagcgactac

SEQ ID NO: 4290 - DNA, 378 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctctctctttctcctacctcatctgggacatcatcatagcctcctgcttctactacgtcgccaccacttacttccctctcctccctcaccctctctcctacttcgcctccagcgcctgcttgccgccatcgtggctggcgatggccaccacctgctccggggtcaagccgtgagggctgggtcatagcccacgagtgcggccaccacgccttcagcgactac

SEQ ID NO: 4291 - DNA, 338 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagtaatcccaccgcactgtttcaaacggtcgatccctcgctctttctcctacctcatctgggacatcatcatagcctcctgcttctactacgtcgccaccacttacttccctctcctccctcaccctctccctctctactgggcctgccaagggtgcgtcctaaccggcgtctgggtcatagcccacgagtgcggccaccgcgccttcagcgactac

SEQ ID NO: 4292 - DNA, 331 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgggcctgccagggctgcgtcctaacgggcctctgggtcatagcccacgagtgcggccaccacgccttcagcgactac

SEQ ID NO: 4293 - DNA, 347 bp, Artificial
  Mutation in BnaA.FAD2.a introduced by TALE nuclease pair BnFAD2_T01
cggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcatgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 4294 - DNA, 332 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccagggctgcgtcctaacgggcctctgggtcatagcccacgagtgcggccaccacgccttcagcgactac

SEQ ID NO: 4295 - DNA, 324 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcgccaagggtgcgtcctaacgggcctctgggtcatcgcccacgaatgcggccaccacgccttcagcgactac

SEQ ID NO: 4296 - DNA, 387 bp, Artificial
  Mutation in BnaA.FAD2.a introduced by TALE nuclease pair BnFAD2_T01
caggatccatgggtgcaggtggaagaatgcaagtgtatcctccctccaaaaagtctgaaaccgacaacatcaagcgcgtaccctgcgagacaccgcccttcactgtcggagaactcaagaaagcaatccaaccgcactgtttcaaacgctcgatccctcgctctttctcctacctcatctgggacatcatcatagcctcctgcttctactacgtcgccaccacttacttccctctcctccctcaccctctctcctaccccggagcaggtggtggccatcgccagccacgatggcgcctggcctctctactgggcctgccagggctgcgtcctaaccggcgtctgggtcatagcccacgagttcggccaccacgccttcaacgactac

SEQ ID NO: 4297 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaacctacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccaagggtgcgtcctaaccggcgtctgggtcatagcccacgagtgcggccaccacgccttcagcgactac

SEQ ID NO: 4298 - DNA, 374 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccaggcttatcttggacaagaagaagatcgctctctactgggcctgccaaggctgcgtcctaacgggcctctgggtcatcgcccacgagtgcggccaccacgccttcagcgactac

SEQ ID NO: 4299 - DNA, 349 bp, Artificial
  Mutation in BnaA.FAD2.a introduced by TALE nuclease pair BnFAD2_T01
caggatccatgggtgcaggtagaagaatgcaagtgtctcctccctcccagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcagagccctcgagtgcggccaccacgccatcagcgactac

SEQ ID NO: 4300 - DNA, 347 bp, Artificial
  Mutation in BnaA.FAD2.a introduced by TALE nuclease pair BnFAD2_T01
caggatccatgggtgcaggtggaagaatgcaagtgtatcctccctcccaaaagtctgaaaccgacaacatcaagcgcgtaccctgcgagacaccgcccttcactgtcggagaactcaagaaagcaatcccaccgcactgtttcaaacgctcgatccctcgctctttctcctacctcatccgggacatcatcatagcctcctgcttctactacgtcgccaccacttacttccctctcctccctcgccctctctccgactggcctctctactgggcctgccaagggtgcgtcctaaccggcttcttggtcatagcccacgagtgctgccaccacgccttcagcgactac

SEQ ID NO: 4301 - DNA, 346 bp, Artificial
  Mutation in BnaA.FAD2.a introduced by TALE nuclease pair BnFAD2_T01
caggatccatgggtgcaggtggaagaatgcaagtgtatcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccagggctgcgtcctaaccggcgtcggggtcatagcccgcgagtgcggtctcctcgccttcatcgactac

SEQ ID NO: 4302 - DNA, 346 bp, Artificial
  Mutation in BnaA.FAD2.a introduced by TALE nuclease pair BnFAD2_T01
caggatccatgggtgcaggtcgaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccagggctgcgtcctaaccggcgtctgggtcaaagcccacgagtgcggccaccacgccttcagcgactac

SEQ ID NO: 4303 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttaaaacgctcgatccctcgctctttctcctacctcatctgggacataatcatagcctcctgcttctactacgtcgccaccacttacttccctctcctccctcaccctctctcctacttctactgggcctgccagggctgcgtcctaaccggcgtctgggtcatagcccacgagtgcggccaccacgccttcagcgactac

SEQ ID NO: 4304 - DNA, 423 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacggtgccaggcccacggcttgaccccggagcaggggggggccatcgccagccacgatggcggcaagcaggcgctggactggcctctctactgggcctgccagggctgcgtcctaaccggcgtctgggtcatagcccacgagtgcggccaccacgccttcagcgacac

SEQ ID NO: 4305 - DNA, 277 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacgccttcagcgactac

SEQ ID NO: 4306 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtccccaccacttacttccctctcctccctcaccctctcccctaccgccctggcctctctactgggcctgccagggctgcgtcctaaccggcgtctgggtcatagcccacgagtgcggccaccacgccttcagcgactac

SEQ ID NO: 4307 - DNA, 347 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttgcctctctactgggcctgccagggctgcgtcctaaccggcgtctgggtcatagcccacgagtgcggccaccacgccttcagcgactac

SEQ ID NO: 4308 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttcccttggcccctctactgggcctgccaaggctgcgtcctaacgggcctctgggtcatcgcccacgaatgcggccaccacgccttcagcgactac

SEQ ID NO: 4309 - DNA, 349 bp, Artificial
  Mutation in BnaA.FAD2.a introduced by TALE nuclease pair BnFAD2_T01
caggatccatgggtgcaggtgcaagaatgcaagtgtatccaccctcccaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctagccggcgtcggggtcatagcccgcgagtgtggcctcgtggcctttgtcgactac

SEQ ID NO: 4310 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctacagggcctgccagggctgcgtcctaaccggcgtctgggtcatagcccacgagtgcggccaccacgccttcagcgactac

SEQ ID NO: 4311 - DNA, 334 bp, Artificial
  Mutation in BnaA.FAD2.a introduced by TALE nuclease pair BnFAD2_T01
caggatccatgggtgcaggtggaagaatgcaagtctatcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccagggctgcgtcctaaccggcgtctgggtcatagcccacgagtgcggccaccacgccttcagcgactac

SEQ ID NO: 4312 - DNA, 338 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattactgggcctgccagggctgcgtcctaaccggcgtctgggtcatagcccacgagtgcggccaccacgccttcagcgactac

SEQ ID NO: 4313 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctcttcgacatcatcatctcctcctcggctcctccctctaccacctctccacagcctacttccctctcctccctcacccactctctactgggcctgccagggctgcgtcctaaccggcgtctgggtcatagcccacgagtgcggccaccacgccttcagcgactac

SEQ ID NO: 4314 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctattgggcctgccaagggtgcgtcctaacgggcctctgggtcatcgcccacgaatgcggccaccacgccttcagcgactac

SEQ ID NO: 4315 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaacgggcctctgggtcatcgcccacgaatgcggccaccacgccttcagcgactac

SEQ ID NO: 4316 - DNA, 349 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgggcctctctactgggcctgccaagggtgcgtcctaaccggcgtctgggtcatagcccacgagtgcggccaccacgccttcagcgactac

SEQ ID NO: 4317 - DNA, 348 bp, Artificial
  Mutation in BnaA.FAD2.a introduced by TALE nuclease pair BnFAD2_T01
caggatcaatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 4318 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctgcctctctactgggcctgccagggctgcgtcctaaccggcgtctgggtaatagcccacgagtgcggccaccacgccttcagcgactac

SEQ ID NO: 4319 - DNA, 344 bp, Artificial
  Mutation in BnaA.FAD2.a introduced by TALE nuclease pair BnFAD2_T01
caggatccatgggtgcaggtggaagaatgcaagtgtatcctccctcccaaaagtctgaaaccgacaaaatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctcgcctctctactgggcctgccaagggtgcgtcctaaccggcgtctgggtcatagcccacgagtgcggcctcctcgccttcgtcgactac

SEQ ID NO: 4320 - DNA, 351 bp, Artificial
  Mutation in BnaA.FAD2.a introduced by TALE nuclease pair BnFAD2_T01
caggatccatgggtgcaggtgcaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccagggctgcgtcctaaccggcgtctgggtcatagcccacgagtgcggccaccacgccttcagcgactac

SEQ ID NO: 4321 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctagcctctctactgggcctgccagggctgcgtcctaaccggcgtctgggtcatagcccacgagtgcggccaccacgccttcagcgactac

SEQ ID NO: 4322 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctcgatccctcgctctttctcctacctcatctgggacatcatcatagcctcctgcttctactacgtcgccaccacttacttccctctcctccctcaccctctcgcctacgctcgcctctctactgggcctgccagggctgcgtcctaaccggcgtctgggtcatagcccacgagtgcggccaccacgccttcagcgactac

SEQ ID NO: 4323 - DNA, 449 bp, Artificial
  Mutation in BnaA.FAD2.a introduced by TALE nuclease pair BnFAD2_T01
caggatccatgggtgcaggtggaagaatgcaagtgtctcctccctccaagaagtccgaaaccgacaacatcaagcgcgtaccctgcgagacaccgcccttcactgtcggagaactcaagaaagcaatcccaccgcactgtttcaaacgctcgatccctcgctccttctcctacctcatctgcgacatcatcatagcctcctgcgtctactacgtcgccaccacttacttccctctcctccctcaccctctcccccgcttcgccacccccccggcttgcccccggagcgggtggtcgccctcgcccgcaatggccgtggcatacaggccctggcgacggtcccgcggctcttgccggggctggcctctctactgtgcctgccagggctgcgtcctaaccggcgtctgggtcatagcccacgaatgcggccaccacgccttcagcgactac

SEQ ID NO: 4324 - DNA, 338 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatccaaccgcactgtttcaaacgctcgatccctcgctctttctcctacctcatctgggacatcatcatagcctcctgcttctactacgtcgccaccacttacttccctctcctccctcaccctctctcctactactgggcctgccaagggtgcgtcctaaccggcgtctgggtcatagcccacgagtgcggccaccacgccttcagcgactac

SEQ ID NO: 4325 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaacctacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccctggcctctctactgggcctgccaagggtgcgtcctaaccggcgtctgggtcatagcccacgagtgcggccaccacgccttcagcgactac

SEQ ID NO: 4326 - DNA, 393 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacactgggcctttcgttttatctgttgtttgtcggtgaacgctctccttggcctctctactgggcctgccaagggtgcgtcctaaccggcgtctgggtcatagcccacgagtgcggccaccacgccttcagcgactac

SEQ ID NO: 4327 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctctatccctcgctctttctcctacctcatctgggacatcatcatagcctcctgcttctactacgtcgccaccacttacttccctctcctccctcaccctctctcctatcctctctactgggcctgccagggctgcgtcctaaccggcgtctgggtcatagcccacgagtgcggccaccacgccttcagcgactac

SEQ ID NO: 4328 - DNA, 347 bp, Artificial
  Mutation in BnaA.FAD2.a introduced by TALE nuclease pair BnFAD2_T01
caggatccatgggtgcaggtcgaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 4329 - DNA, 345 bp, Artificial
  Mutation in BnaA.FAD2.a introduced by TALE nuclease pair BnFAD2_T01
caggatccatgggtgcaggtggaagaatgcaagtgtctcctccatccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccccttcgcctctctactgggcctgccagggctgcgtcctaaccggcgtctgggtcatagcccacgagtgcggccaccacgccttcagcgactac

SEQ ID NO: 4330 - DNA, 350 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctggcctctctactgggcctgccagggctgcgtcctaaccggcgtctgggtcatagcccacgagtgcggccaccacgccttcagcgactac

SEQ ID NO: 4331 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccgcctggcctctctactgggcctgccagggctgcgtcctaaccggcgtctgggtcatagcccacgagtgcggccaccacgccttcagcgactac

SEQ ID NO: 4332 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcttctctactgggcctgccaagggtgcgtcctaaccggcgtctgggtcatagcccacgagtgcggccaccacgccttcagcgactac

SEQ ID NO: 4333 - DNA, 350 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 4334 - DNA, 331 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctccgggcctgccagggctgcgtcctaaccggcgtctgggtcatagcccacgaatgcggccaccacgccttcagcgactac

SEQ ID NO: 4335 - DNA, 332 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaacatcaagcgcgtaccctgcgagacaccgcccttcactgtcggagaactcaagaaagcaatcccaccgcactgtctcaaacgctcgatccctcgctctttctcctacctcatctgggacatcatcatagcctcctgcttctactacgtcgccaccacttacttccctctcctccctcaccctctctactgggcctgccagggctgcgtcctaaccggcgtctgggtcatagcccacgagtgcggccaccacgccttcatcgactac

SEQ ID NO: 4336 - DNA, 357 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgccgccaccacttacttccctctcctccctcaccctctctcctcctccccccgcctggcctctctactgggcctgccagggctgcgtcctaaccggcgtctgggtcatagcccacgagtgcggccaccacgccttcagcgactac

SEQ ID NO: 4337 - DNA, 355 bp, Artificial
  Mutation in BnaA.FAD2.a introduced by TALE nuclease pair BnFAD2_T01
caggatccatgggtgcaggtggcagaatgcaagtctctcctccctccaagaagtctgaaacctacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccagggctgcgtcctaaccggcgtctgggtcatagcccacgattgcggccaccacgccttcagcgactac

SEQ ID NO: 4338 - DNA, 341 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgggcctgccagggctgcgtcctaacgggcctctgggtcatagcccacgagtgcggccaccacgccttcagcgactac

SEQ ID NO: 4339 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctagcctctctactgggcctgccagggctgcgtcctaaccggcgtctgggtcatagcccacgagtgcggccaccacgccttcagcgactac

SEQ ID NO: 4340 - DNA, 344 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctcgcctggcctctctactgggcctgccagggctgcgtcctaaccggcgtctgggtcatagcccacgagtgcggccaccacgccttcagcgactac

SEQ ID NO: 4341 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgaatgcggccaccacgccttcagcgactac

SEQ ID NO: 4342 - DNA, 349 bp, Artificial
  Mutation in BnaA.FAD2.a introduced by TALE nuclease pair BnFAD2_T01
caggatccatgggtgcaggtggaagaatgcaagtgtatactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 4343 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgctagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcgcctggcctctctactgggcctgccaaggctgcgtcctaacgggcctctgggtcatagcccacgagtgtggccaccacgccttcagcgactac

SEQ ID NO: 4344 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccaaggctgcgtcctaacgggcctctgggtcatagcccacgagtgcggccaccacgccttcagcgactac

SEQ ID NO: 4345 - DNA, 343 bp, Artificial
  Mutation in BnaA.FAD2.a introduced by TALE nuclease pair BnFAD2_T01
caggatccatgggtgcaggtagaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccagggctgcgtcctaaccggcgtctgggtcatcgcccacgaatgcggccaccacgccttcatcgactac

SEQ ID NO: 4346 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccccccccctctcgcctggcctctctactgggcctgccagggctgcgtcctaaccggcgtctgggtcatagcccacgagtgcggccaccacgccttcagcgactac

SEQ ID NO: 4347 - DNA, 404 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcttgccgccatcgtggctggcgatggccaccacctgctccggggtcaagccgtgggcctctctactgggcctgccaagggtgcgtcctaaccggcgtctgggtcatagcccacgagtgtggccaccacgccttcagcgactac

SEQ ID NO: 4348 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgtgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 4349 - DNA, 358 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcggcgggtctggcctctctactaggcctgccagggctgcgtcctaaccggcgtctgggtcatagcccacgagtgcggccaccacgccttcagcgactac

SEQ ID NO: 4350 - DNA, 355 bp, Artificial
  Mutation in BnaA.FAD2.a introduced by TALE nuclease pair BnFAD2_T01
caggatccatgggtgcagggagaagaatgcaagtgtctcctccctccaaaaagtctgaaaacgacaacatcaagcgcgtaccctgcgagacaccgcccttcactgtcggggaactcaagaaagcaatcccaccgcactgtttcaaacgctcgatccctcgctctttctcctacctcatctgggacatcatcatagcctcctgcttctactacgtcgccaccacttactcccctctcctccctcaccctctcgcctacttcgcccctggcctctctactgggcctgccagggctgcgtcctaaccggcgtctgggtcagagcccacgagtgctgccaccacgccatcagcgactcc

SEQ ID NO: 4351 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcacctacttctggcctctctactgggcctgccagggctgcgtcctaaccggcgtctgggtcatagcccacgagtgcggccaccacgccttcagcgactac

SEQ ID NO: 4352 - DNA, 332 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccaagggtgcgtcctaaccggcgtctgggtcatagcccacgagtgctgccaccgcgccttcagcgactac

SEQ ID NO: 4353 - DNA, 323 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccaccattcactctcggagacctcaagaaagcaatcccacctcactgcttcaaacgctccatcccacgctctttctcctacctcatctgggacatcatcatagcctcctgcttctactacgtcgccaccacttacttccctcgagccacccactgggcctgccaatggtgcgtcctaaccggcgtctgggtcatagcccacgagtgcggccaccacgccttcagcgactac

SEQ ID NO: 4354 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcgcctctctactgggcctgccagggctgcgtcctaaccggcgtctgggtcatagcccacgagtgcggccaccacgccttcagcgactac

SEQ ID NO: 4355 - DNA, 352 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccatcaccctctctcctgcttcgctagcctctctactgggcctgccagggctgcgtcctaaccggcgtctgggtcatagcccacgagtgcggccaccacgccttcagcgactac

SEQ ID NO: 4356 - DNA, 335 bp, Artificial
  Mutation in BnaA.FAD2.a introduced by TALE nuclease pair BnFAD2_T01
cagtatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccagggctgcgtcctaaccgtcgtctgggtcatagcccacgagtgcggccaccacgccttcagcgactac

SEQ ID NO: 4357 - DNA, 357 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccggtttgcgtattgccggtgcctggcctctctactgggcctgccaaggctgcgtccgaacgggcctcggggtcatagcccacgagtgcggccaccacgccttcagcgactac

SEQ ID NO: 4358 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgattcctcgctctttctcctacctcatctgggacatcatcatagcctcctgcttctactacgtcgccaccacttacttccctctcctccctcaccctctctcctactttggcctctctactgggcctgccaagggtgcgtcctaacgggcctctgggtcatcgcccacgaatgcggccaccacgccttcagcgactac

SEQ ID NO: 4359 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctccatcccacgctccttctcctcttcgacatcatcatctcctcctcggctcctccctctaccacctctccacagcctacttccctctcctccctcaccctctctcctactggcctctctactgggcctgccagggctgcgtcctaaccagcgtctgggtcatagcccacgagtgcggccaccacgccttcagcgactac

SEQ ID NO: 4360 - DNA, 349 bp, Artificial
  Mutation in BnaA.FAD2.a introduced by TALE nuclease pair BnFAD2_T01
caggatccatgggtgcagctggaagaatgcaagtgtatcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgtggcctctctactgggcctgccaagggtgcgtcctaaccggcgtctgggtcatagcccacgagtgcgtccaccacgccttcagcgactac

SEQ ID NO: 4361 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctggcctctctactgggcctgccagggctgcgtcctaaccggcgtctgggtcatagcccacgagtgcggccaccacgccttcagcgactac

SEQ ID NO: 4362 - DNA, 342 bp, Artificial
  Mutation in BnaA.FAD2.a introduced by TALE nuclease pair BnFAD2_T01
caggatccatgggtgtaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctactctctactgggcctgccagggcggcgtcctaactggcgtctggggcatagcccacgagtgcggccaccgcgcctgcagtgactac

SEQ ID NO: 4363 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgcttcaaacgctcgatcccacgctctttctcctatctcatctgagacatcatcacagcctcctgctcctactacgtcgccaccactctccttcctctcctccttcaccctctcgcccctagcccctctactgggcctgccaaggctgcgtcctaaccggcctctgggtcatagcccacgagtgcggccaccacgccttcagcgactac

SEQ ID NO: 4364 - DNA, 438 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccagctgggccttgtagttgcccttgaagtggccggacacgaacaggaacttgaactcggtcacgctggaggggtacaccttccacctggcctctctactgggcctgccaagggtgcgtcctaaccggcgtctgggtcatagcccacgagtgcggccaccacgccttcagcgactac

SEQ ID NO: 4365 - DNA, 349 bp, Artificial
  Mutation in BnaA.FAD2.a introduced by TALE nuclease pair BnFAD2_T01
caggatccatgggtgcaggtggaagaatgcaagtgaatcctcactccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccagggctgcgtcctaaccggcgtctgggtcatagcccacgagtgcggccaccacgccttcagcgactac

SEQ ID NO: 4366 - DNA, 440 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccccagcggctgttgccaccattattgctggcgatggccaccacctgctggggggtcaagccttgggatcagggcgagataactgggcaacaatgctctccagcgccggcctctctactgggcctgccaagggtgcgtcctaaccggcgtctgggtcatagcccacgagtgcggccaccacgccatcagcgactac

SEQ ID NO: 4367 - DNA, 345 bp, Artificial
  Mutation in BnaA.FAD2.a introduced by TALE nuclease pair BnFAD2_T01
caggatccatgggtgcaggtagaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggccggccagggctgcgtcctaaccggcgtctgggtcatagcccacgagtgcggccaccactccttcagcgactac

SEQ ID NO: 4368 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgcgagggctgcgtcctaaccggcgtctgggtcatagcccacgagtgcggcctccacgccatcagcgactac

SEQ ID NO: 4369 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgctcccctctctactgggcctgccagggctgcgtcctaaccggcgtctgggtcatagcccacgagtgcggccaccacgccttcagcgactac

SEQ ID NO: 4370 - DNA, 337 bp, Artificial
  Mutation in BnaA.FAD2.a introduced by TALE nuclease pair BnFAD2_T01
caggatccatgggtgcaggtggcagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacactgggcctgccagggctgcgtcctaaccggcgtctgggtcatagcccacgagtgcggccaccacgccttcagcgactac

SEQ ID NO: 4371 - DNA, 419 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctctcctactaagactgggcctttcgttttatctgttgtttgtcggtgaacgctctcctgagtaggacaaatccgctcccttggcttttttactgggcctgccagggctgcgtcctaaccggcgtctgggtcatagcccacgagtgcggccaccacgccttcagcgactac

SEQ ID NO: 4372 - DNA, 334 bp, Artificial
  Mutation in BnaA.FAD2.a introduced by TALE nuclease pair BnFAD2_T01
caggatccatgggtgcaggtggaagaatgcaagtctctcctccccccagctcccccggaaccaacaccctcaaacgcgtcccctgcgagacaccaccattcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccagggctgcgtcctaaccggcgtctgggtcatagcccacgagtgcggccaccacgccttcagcgactac

SEQ ID NO: 4373 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgcccccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 4374 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgcactttctcctacctcatctgggacatcatcatagcctcctgcttctactacgtcgccaccacttacttccctctcctccctcaccctctctcctacttctctactgggcctgccagggctgcgtcctaaccggcgtctgggtcatagcccacgagtgcggccaccacgccttcagcgactac

SEQ ID NO: 4375 - DNA, 339 bp, Artificial
  Mutation in BnaA.FAD2.a introduced by TALE nuclease pair BnFAD2_T01
caggatccatgggtgcaggtggaagaatgcaagtgtctcctccctccagctctcccggaaccaacaccctcaaacgcgtcccctgcgagacaccaccattcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttactgggcctgccagggctgcgtcctaaccggcgtctgggtcatagcccacgagtgcggccaccacgccttcagcgactac

SEQ ID NO: 4376 - DNA, 339 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatccctcgctccttctcctacctcatctgggacatcctcctagcctcctgcttctactacgtcccccccaccttcttccctctcctccctcctcccctcacccccctactgggcctgccagggctgcgtcctaaccggcgtctgggtcatagcccacgagtgcggccaccacgccttcagcgactac

SEQ ID NO: 4377 - DNA, 329 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgccaagggtgcgtcctaaccggcgtcggggtcatagcccacgagtgcggccaccacgccttcagcgactac

SEQ ID NO: 4378 - DNA, 431 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttttgccggtgctgtgccaggcgctcggtcgttcggctgcggcgagcggtatcagctcactcaaaggcggtaatacggttaccctggcctctctactgggcctgccagggctgcgtcctaaccggcgtctgggtcatagcccacgagtgcggccaccacgccttcagcgactac

SEQ ID NO: 4379 - DNA, 347 bp, Artificial
  Mutation in BnaA.FAD2.a introduced by TALE nuclease pair BnFAD2_T01
caggatccagggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 4380 - DNA, 342 bp, Artificial
  Mutation in BnaA.FAD2.a introduced by TALE nuclease pair BnFAD2_T01
caggatccatgggtgcagggggaagaatgcaagtgtctcctccctcccaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttactcccctctcctccctcaccctctctcctactctctactggtccggccaggactgcgtcctaaccggcgtctgggtcatagcccaccagggcggccaccacgccttcagcgactac

SEQ ID NO: 4381 - DNA, 415 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggagacgatggccaccacctgctggggggtcaagttgagcggggcacccgtcagtgcatgcatggcctctctactgggcctgccagggctgcgtcctaacgggcctctgggtcatagcccacgagtgcggccaccacgccttcagcgactac

SEQ ID NO: 4382 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtctggcctctctactgggcctgccagggctgcgtcctaaccggcgtctgggtcatagcccacgagtgcggccaccacgccttcagcgactac

SEQ ID NO: 4383 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctggcctctctactgggcctgccaagggtgcgtcctaaccggcgtctgggtcatagcccacgagtgcggccaccacgccgtcagcgactac

SEQ ID NO: 4384 - DNA, 346 bp, Artificial
  Mutation in BnaA.FAD2.a introduced by TALE nuclease pair BnFAD2_T01
caggatccatgggtgcagttggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttatttctctctcctccctcaccctctctcctgcgacctctctactgagcctgccagggctgcgtcctaaccggcgtctgggttatagcccacgagtgcgtccaccgcgccaacagcgactac

SEQ ID NO: 4385 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctctctactgggcctgccagggctgcgtcctaacgggcctctgggtcatagcccacgagtgcggccaccacgccttcagcgactac

SEQ ID NO: 4386 - DNA, 348 bp, Artificial
  Mutation in BnaA.FAD2.a introduced by TALE nuclease pair BnFAD2_T01
caggatccatgggtgcaggtggaagaatgcaagtgtctcctccctccacgaagtctgaaaccgccaccatcaagcgcgtaccctgcgcgacaccgcccttccctgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctggcctctctactgggcctgccagggctgcgtcctaaccggcgtctggggcatagcccacgagtgcggccaccacgccttcagcgactac

SEQ ID NO: 4387 - DNA, 351 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcggcctctctactgggcctgccagggctgcgtcctaaccggcgtctgggtcatagcccacgagtgcggccaccacgccttcagcgactac

SEQ ID NO: 4388 - DNA, 321 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctccatccctcgctccttctcctacctcatctgggacatcatcatagcctcctgcttctactacgtcgccaccacttacttccctctcctccctcaccctctctcaagggtgcgtccgaaccggcgtcggggtcatagcccacgagtgcggcgaccacgccttcagcgactac

SEQ ID NO: 4389 - DNA, 346 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacccaccatcccacgctccttctcctacctcatctgggacatcatcatagcctcctgcttctactacgtcgccaccacttacttccctctcctccctccccctctctcctccttcctctctactgggcctgccagggctgcgtcctaaccggcgtctgggtcatagcccacgagtgcggccaccacgccttcagcgactac

SEQ ID NO: 4390 - DNA, 398 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgccaacctcccaagagtgcaaaacgtggcggcgtgaccgcagtggaggcagtgcatgcgcctctctactgggcctgccaaggctgcgtcctaacgggcctctgggtcatagcccacgaatgcggccaccacgccttcagcgactac

SEQ ID NO: 4391 - DNA, 348 bp, Artificial
  Mutation in BnaA.FAD2.a introduced by TALE nuclease pair BnFAD2_T01
caggatccatgggtgcaggcggcagaatgcaagtgactcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctgcctggcctctctactgggcctgccaagggtgcgtcctaaccggcggctgggtcatagcccacgagggcggccaccacgccggcagcgactac

SEQ ID NO: 4392 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcccgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 4393 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtcttggtcatagcccacgagtgcggccaccacgccttcagcgactac

SEQ ID NO: 4394 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacctccctctcctccctcaccctctctcctactttggcctctctactgggcctgccaagggtgcgtcctaaccggcgtctgggtcatacccccctagtgcggccaccacgccttcagcgactac

SEQ ID NO: 4395 - DNA, 356 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctcccctacttcgccgcctggcctctctactgggcctgccagggctgcgtcctaaccggcgtctgggtcatagcccacgagtgcggccaccacgccttcagcgactac

SEQ ID NO: 4396 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttctggcctctctactgggcctgccagggctgcgtcctaaccggcgtctgggtcatagcccacgagtgcggccaccacgccttcagcgactac

SEQ ID NO: 4397 - DNA, 417 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctctttctcctacctcatctgggacatcatcatagcctcctgcttctactacgtcgccaccacttacttccctctcctccctcaccctctctcctacttcgtcaggacatgatcgcagcgttgccagagcgagattctccgcgctgtagaagtcaccattgttgtgctggcctctctactgggcctgccagggctgcgtcctaaccggcgtctgggtcatagcccacgagtgcggccaccacgccttcagcgactac

SEQ ID NO: 4398 - DNA, 324 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcttgccaagggtgcgtcctaaccggcgtctgggtcatagcccacgaatgcggccaccacgccttcagcgactac

SEQ ID NO: 4399 - DNA, 277 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcacgccttcagcgactac

SEQ ID NO: 4400 - DNA, 356 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgccgcctggcctctctactgggcctgccagggctgcgtcctaaccggcgtctgggtcatagcccacgagtgcggccaccacgccttcagcgactac

SEQ ID NO: 4401 - DNA, 331 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgggcctgccagggctgcggcctaaccggcgtctgggtcatagcccacgagtgcggccaccacgccttcagcgactac

SEQ ID NO: 4402 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctggcctctctactgggcctgccagggctgcgtcctaaccggcgtctgggtcatagcccacgagtgcggccaccacgccttcagcgactac

SEQ ID NO: 4403 - DNA, 348 bp, Artificial
  Mutation in BnaA.FAD2.a introduced by TALE nuclease pair BnFAD2_T01
caggatccatgggtgcaggtggaagaatgcaagtgtctcctcactccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtcggggtcatagcccacgagtgcggccaccacgccttcagcgactac

SEQ ID NO: 4404 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccaagggtgcggcctaaccggcgtctgggtcatagcccacgagtgcggccaccacgccttcagcgactac

SEQ ID NO: 4405 - DNA, 352 bp, Artificial
  Mutation in BnaA.FAD2.a introduced by TALE nuclease pair BnFAD2_T01
caggatccattggtgcaggtggaagaatgcaagtgtctcctccctccaaaaagtctgaaaccgacaacatcaagcgcgtaccctgcgagacaccgcccttcactgtcgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccgccctggcctctctactgggcctgccagggctgcgtcctaaccggcgtctgggtcatagcccacgagtgcggccaccacgccttcagcgactac

SEQ ID NO: 4406 - DNA, 331 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcaccatagcctcctgcttctactacgtcgccaccacttacttccctctcctccctcaccctctctccgggcctgccagggctgcgtcctaaccggcgtctgggtcatagcccacgagtgcggcgaccacgccttcagcgactac

SEQ ID NO: 4407 - DNA, 335 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcctctctactgggcctgccagggctgcgtcctaaccggcgtctgggtcatagcccacgagtgcggccaccacgccttcagcgactac

SEQ ID NO: 4408 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccgccacttacttccctctcctccctcaccctcctctctactgggcctgccagggctgcgtcctaacgggcctctgggtcatcgcccacgaatgcggccaccacgccttcagcgactac

SEQ ID NO: 4409 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctccccctctctcctacttcctctctactgggcctgccagggctgcgtcctaacgggcctctgggtcatcgcccacgaatgcggccaccacgccttcagcgactac

SEQ ID NO: 4410 - DNA, 332 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccagggctgcgtcctaaccggcgtctgggtcatagcccacgagtgcggccaccacgccttcagcgactac

SEQ ID NO: 4411 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctggcatctctactgggcctgccagggctgcgtcctaaccggcgtctgggtcatagcccacgagtgcggccaccacgccttcagcgactac

SEQ ID NO: 4412 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccagggctgcgtcctaaccggcgtctgggtcatagcccacgagtgcggccaccacgccttcagcgactac

SEQ ID NO: 4413 - DNA, 352 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccgccctggcctctctactgggcctgccagggctgcgtcctaaccggcgtctgggtcatagcccacgagtgcggccaccacgccttcagcgactac

SEQ ID NO: 4414 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacactcgatccctcgctctttctcctacctcatctgggacatcatcatagcctcctgcttctactacgtcgccaccacttacttccctctcctccctcaccctctctcctatctctactgggcctgccaagggtgcgtcctaaccggcgtctgggtcatagcccacgagtgcggccaccacgccttcagcgactac

SEQ ID NO: 4415 - DNA, 357 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctggaacatcatcatagcctcctgcttctactacgtcgccaccacttacttccctctcctccctcaccctctctcctcctccccccgcctggcctctctactgggcctgccagggctgcgtcctaaccggcgtctgggtcatagcccacgagtgcggccaccacgccttcagcgactac

SEQ ID NO: 4416 - DNA, 338 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccctctctactgggcctgccagggctgcgtcctaaccggcgtctgggtcatagcccacgagtgcggccaccacgccttcagcgactac

SEQ ID NO: 4417 - DNA, 358 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctcgcctggcccctctactgggcctgccaaggctgcgtcctaacgggcctctgggtcatcgcccacgaatgcggccaccacgccttcagcgactac

SEQ ID NO: 4418 - DNA, 346 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgagtgcggccaccacgccttcagcgactac

SEQ ID NO: 4419 - DNA, 374 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccaggcttatcttggacaagaagaagatcgctctctactgggcctgccagggctgcgtcctaaccggcgtctgggtcatagcccacgagtgcggccaccacgccttcagcgactac

SEQ ID NO: 4420 - DNA, 387 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctcccccggagcaggtggtggccatcgccagccacgatggcgcctggcctctctactgggcctgccagggctgcgtcctaaccggcgtctgggtcatagcccacgagtgcgtccaccacgccttcagcgactac

SEQ ID NO: 4421 - DNA, 331 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgggcctgccagggctgcgtcctaaccggcgtctgggtcatagcccacgagtgcggccaccacgccttcagcgactac

SEQ ID NO: 4422 - DNA, 346 bp, Artificial
  Mutation in BnaA.FAD2.a introduced by TALE nuclease pair BnFAD2_T01
caggatccatgggtgcaggtggcagaatgcaagtgtctcctcactccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccagggctgcgtcctaaccggcgtctgggtcatagcccacgagtgcggccaccacgccctcagcgactac

SEQ ID NO: 4423 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttttggcctctctactgggcctgccagggctgcgtcctaaccggcgtctgggtcatagcccacgagtgcggccaccacgccttcagcgactac

SEQ ID NO: 4424 - DNA, 348 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggttatagcccacgagtgcggccaccacgccatcagcgactac

SEQ ID NO: 4425 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcttcctctctactgggcctgccagggctgcgtcctaaccggcgtctgggtcatagcccacgagtgcggccaccacgccttcagcgactac

SEQ ID NO: 4426 - DNA, 343 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgccttcagcgactac

SEQ ID NO: 4427 - DNA, 356 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcccctctactgggcctgccaaggctgcgtcctaacgggcctctgggtcatcgcccacgaatgcggccaccacgccttcagcgactac

SEQ ID NO: 4428 - DNA, 342 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcgcctggcctctctactgggccggccaagagtgcgtcctaaccggcgtcggtgtcatagcccgcgagggcgaccaccacgccgtcagcgactac

SEQ ID NO: 4429 - DNA, 348 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttcccgctcctccctcaccctctcgcctacttggcctctctactgggccggccagggctgcggcctaaccggcgtcggggtcatagcccacgagtgcggccaccacgccatcagcgactac

SEQ ID NO: 4430 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcccccctcaccctctctcctagcctctctactgggcctgccaagggtgcgtcctaaccggcgtctgggtcatagcccacgagtgcggccaccacgccttcagcgactac

SEQ ID NO: 4431 - DNA, 349 bp, Artificial
  Mutation in BnaA.FAD2.a introduced by TALE nuclease pair BnFAD2_T01
caggatccatgggtgcaggtggcagaatgcaagtctctcctctctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactatggcctctctactgggcctgccagggctgcggcctaaccgacgtctgggtcatagcccacgagtgcggccaccacgccatcagcgactac

SEQ ID NO: 4432 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctaccaagggtgcgtcctaaccggcgtctgggtcatagcccacgagtgcggccaccacgccttcagcgactac

SEQ ID NO: 4433 - DNA, 345 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgccttcagcgactac

SEQ ID NO: 4434 - DNA, 355 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcccctggcctctctactgggccggccagggctgcgtcctaaccggcgtctgggtcatagcccacgagtgcggccaccacgccttcagcgactac

SEQ ID NO: 4435 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctcgctactgggcctgccagggctgcgtcctaaccggcgtctggggcatagcccacgagtgcggctagcacgccctcagtgactac

SEQ ID NO: 4436 - DNA, 351 bp, Artificial
  Mutation in BnaA.FAD2.a introduced by TALE nuclease pair BnFAD2_T01
caggatcaatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccagggctgcgtcctaaccggcgtctgggtcatagcccacgagtgcggccaccacgccttcagcgactac

SEQ ID NO: 4437 - DNA, 386 bp, Artificial
  Mutation in BnaA.FAD2.a introduced by TALE nuclease pair BnFAD2_T01
caggatccatgggtgcaggtggatgaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggccaccacctgctggggggtcaagccgtgggcctggcacagtctctactgggcctgccagggctgcgtcctaaccggcgtctgggtcatagcccacgagtgcggccaccacgccttcggcgactac

SEQ ID NO: 4438 - DNA, 344 bp, Artificial
  Mutation in BnaA.FAD2.a introduced by TALE nuclease pair BnFAD2_T01
caggatccatgggtgcaggtggcagaatgcaagtgtctcctcactccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccagcctctctactgggcctgccaagggtgcgtcctaaccggcgtctgggtcatagaccacgagtgcggccaccacgcctgcagcgactac

SEQ ID NO: 4439 - DNA, 339 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctactgggcctgccagggctgcgtcctaacgggcctctgggtcatcgcccacgaatgcggccaccacgccttcagcgactac

SEQ ID NO: 4440 - DNA, 334 bp, Artificial
  Mutation in BnaA.FAD2.a introduced by TALE nuclease pair BnFAD2_T01
caggatccatgggtgcaggtcgcagaatgcaagtgcctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccaagggtgcgtcctaaccggcgtctgggtcatagcccgcgggtgcggccaccacgccttcagcgactac

SEQ ID NO: 4441 - DNA, 347 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcggcctaaccggcgtctgggtcatagcccacgagtgcggccaccacgccttcagcgactac

SEQ ID NO: 4442 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccagggctgcgtcctaaccggcgtctgggtcatagcccacgagtgcggccaccacgccttcagcgactac

SEQ ID NO: 4443 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgctgctggcctctctactgggcctgccagggctgcggcctaaccggcgtcggggtcatatcccacgagtgcggccaccacgccttcagcgactac

SEQ ID NO: 4444 - DNA, 344 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctcgcctggcctctctactgggcctgccagggctgcgtcctaaccggcgtctgggtcatagcccacgagtgcggccaccacgccttcagcgactac

SEQ ID NO: 4445 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctccttcctcaccctctctcctacggcctctctactgggcctgccagggctgcgtcctaaccggcgtctgggtcatagcccacgagtgcggccaccacgccttcagcgactac

SEQ ID NO: 4446 - DNA, 347 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacaggcctctctactgggcctgccagggctgcgtcctaaccggcgtctgggtcatagcccacgagtgcggccaccacgccttcagcgactac

SEQ ID NO: 4447 - DNA, 347 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagaactcaagaaagcaatcccaccgcactgtttcaaacgctcgatccctcgctctttctcctacctcatctggcacatcatcatagcctcctgcttctactacgtcgccaccacttacttccctctcctccctcaccctctctcctactggcctctctactgggcctgccagggctgcgtcctaaccggcgtctgggtcatagcccacgagtgcggccaccacgccttcagcgactac

SEQ ID NO: 4448 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctccttctcctacctcatctgggacatcatcatagcctcctgcttctactacgtcgccaccacttacttccctctcctccctcaccctctctcctactttggcctctctactgggcctgccaaggctgcgtcctaacgggcctctgggtcatcgcccacgaatgcggccaccacgccttcagcgactac

SEQ ID NO: 4449 - DNA, 335 bp, Artificial
  Mutation in BnaA.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccagagctgcgtcctaaccggcgtctgggtcatagcccacgagtgcggccaccacgccttcagcgactac

SEQ ID NO: 4450 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctctactgggcctgccagggctgcgtcctaaccggcgtctgggtcatagcccacgagtgcggccaccacgccttcagcgactac

SEQ ID NO: 4451 - DNA, 417 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtcaggacatgatcgcagcgttgccagagcgagattctccgcgctgtagaagtcaccattgttgtgctggcctctctactgggcctgccagggctgcgtcctaaccggcgtctgggtcatagcccacgagtgcggccaccacgccttcagcgactac

SEQ ID NO: 4452 - DNA, 354 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcctcaccctctctcctacttcgcgcctggcctctctactgggcctgccagggctgcgtcctaaccggcgtctgggtcatagcccacgagtgcggccaccacgccttcagcgactac

SEQ ID NO: 4453 - DNA, 455 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttaccccgcctgccggcgatggccaccccctgctccggggtcaagccgtgggcctggcacagcaccggggcggcgtgaccgcagtggaggcagtgcatgcatggcgctcgcctggcccctctactgggcctgccaaggctgcgtcctaaccggcgtctgggtcatagcccacgagtgcggccaccacgccttcagcgactac

SEQ ID NO: 4454 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaaggctgcgtcctaacgggcctctgggtcatcgcccacgagtgcggccaccacgccttcagcgactac

SEQ ID NO: 4455 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgccctgtttcaaacgctcgatccctcgctctttctcctacctcatctgggacatcatcatagcatcctgcttctactacgtcgccaccacttacttccctctcctccctcaccctctctcctacgatggcctctctactgggcgtgccagggccgcgtcctaaccggcgtcggcgtcatagcccacgagtgcggccaccgcgccaacagcgactac

SEQ ID NO: 4456 - DNA, 345 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccagggctgcgtcctaaccggcgtctgggtcatagcccacgagtgcggccaccacgccttcagcgactac

SEQ ID NO: 4457 - DNA, 355 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccaagggtgcgtcctaaccggcgtctgggtcatagcccacgagtgcggccaccacgccttcagcgactac

SEQ ID NO: 4458 - DNA, 438 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttaatgtttaactttgttttagggcgactgccctgcggcgtaacatcgttgctggacagcatcgatatcgccgacctacgcacgctcgacctggcctctctactgggcctgccaaggctgcgtcctaacgggcctctgggtcatagcccacgagtgcggccaccacgccttcagcgactac

SEQ ID NO: 4459 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctgcctctctactgggcctgccagggctgcgtcctaaccggcgtctgggtcatagcccacgagtgcggccaccacgccttcagcgactac

SEQ ID NO: 4460 - DNA, 343 bp, Artificial
  Mutation in BnaA.FAD2.a introduced by TALE nuclease pair BnFAD2_T01
caggatccatgggtgcaggtggcagaatgcaagtgtctcctcactccaagaagtctgaaaccgacaccatcaagcgcgtaccctgcgagacaccgcccttcactgtcggagaactcaagaaagcaatcccaccgcactgcttcaaacgctcgatccctcgctctttctcctacctcatctgggacatcatcatagcctcctgcttctactacgtcgccaccacttacttccctctcctccctcaccctctcacctacttctctactgggcctgccggggctgcgtcctaaccggcgtctgggtcatagcccacgagtgcggccaccacgccttcagcgactac

SEQ ID NO: 4461 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacttggcctctctactgggcctgccaaggctgcgtcctaacgggcctctgggtcatagcccacgagtgcggccaccacgccatcagcgactgc

SEQ ID NO: 4462 - DNA, 352 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggcctctctactgggcctgccagggctgcgtcctaaccggcgtctgggtcatagcccacgagtgcggccaccacgccttcagcgactac

SEQ ID NO: 4463 - DNA, 339 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttactgggcctgccagggctgcgtcctaaccggcgtctgggtcatagcccacgagtgcggccaccacgcctgcagcgactac

SEQ ID NO: 4464 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttcccctacctcatctgggacatcatcatagcctcctgcttctactacgtcgccaccacttacttccctctcctccctcaccctctctcctacttcggcctctctactgggcctgccagggctgcgtcctaaccggcgtctgggtcatagcccacgagtgcggccaccacgccttcagcgactac

SEQ ID NO: 4465 - DNA, 329 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgggcctgccagggctgcgtcctaacctgcgtctgggtcatagcccacgagtgcggccaccacgccttcagcgactac

SEQ ID NO: 4466 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccaagggtgcgtcctaacctgcgtctgggtcatagcccacgagggcggccaccacgccttcagcgactac

SEQ ID NO: 4467 - DNA, 372 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctctccagcggctgttgccgccatcgtgcccctctactgggcctgccaaggctgcgtcctaacgggcctctgggtcatcgcccacgaatgcggccaccacgccttcagcgactac

SEQ ID NO: 4468 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgcctgggctgcgtcctaaccggcgtctgggtcatagcccacgagtgcggccaccacgccttcagcgactac

SEQ ID NO: 4469 - DNA, 347 bp, Artificial
  Mutation in BnaA.FAD2.a introduced by TALE nuclease pair BnFAD2_T01
caggatccatgggtgcaggtggaagaatgcaagtgcctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacaggcctctctactgggcctgccagggctgcgtcctaaccggcgtctgggtcatagcccacgagtgcggccaccacgccttcagcgactac

SEQ ID NO: 4470 - DNA, 343 bp, Artificial
  Mutation in BnaA.FAD2.a introduced by TALE nuclease pair BnFAD2_T01
caggatccatgggtgcaggtggaagaatgcaagtgtctcccccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctgcctctctactgggcctgccaagggtgcgtcctaaccggcgtctgggtcatagcccacgagtgcggccaccacgccttcagcgactac

SEQ ID NO: 4471 - DNA, 346 bp, Artificial
  Mutation in BnaA.FAD2.a introduced by TALE nuclease pair BnFAD2_T01
caggatccatgggtgcaggtggaagaatgcaagtgtctcctccctccagctcccccgaaaccaaaaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccagggctgcgtcctaacgggcgtctgggtcatagcccacgagtgcggccaccacgccttcagcgactac

SEQ ID NO: 4472 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctctctactgggcctgccaagggtgcgtcctaaccggcgtctgggtcatagcccacgagtgcggccaccacgccttcagcgactac

SEQ ID NO: 4473 - DNA, 358 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctgtctcctacctcatctgggacatcatcatagcctcctgcttctactacgtcgccaccacttacttccctctcctccctcaccctctctcctacttcgcctcgcctggcctctctactgggcctgccaagggtgcgtcctaaccggcgtctgggtcatcgcccacgaatgcggccaccacgccttcagcgactac

SEQ ID NO: 4474 - DNA, 333 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctccttctcctcttcgacatcatcatctcctcctcggctcctccctctaccacctctccacagcctacttccctctcctccctcaccctctctactgggcctgccagggctgcgtcctaaccggcgtctgggtcatagcccacgagtgcggccaccacgccttcagcgactac

SEQ ID NO: 4475 - DNA, 347 bp, Artificial
  Mutation in BnaA.FAD2.a introduced by TALE nuclease pair BnFAD2_T01
caggatccatgggtgcaggtggaagaatgcaagtgtctcatccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctggaacatcatcatagcctcctgcttctactacgtcgccaccacttacttccctctcctccctcaccctctctcccactaggcctctctactgggcgtgccagggctgcgtccgaaccggcgtctgggtcatagcccacgagtgcggccaccccgccttagcgactac

SEQ ID NO: 4476 - DNA, 373 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctctccagcgcctgcttgccgccatcgtgcccctctactgggcctgccaaggctgcgtcctaacgggcctctgggtcatcgcccacgaatgcggccaccacgccttcagcgactac

SEQ ID NO: 4477 - DNA, 339 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttactgggcctgccagggctgcgtcctaaccggcgtctgggtcatagcccacgagtgcggccaccacgccttcagcgactac

SEQ ID NO: 4478 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccgcgccttcagcgactac

SEQ ID NO: 4479 - DNA, 351 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccagggctgcgtcctaaccggcgtctgggtcatagcccacgagtgcggccaccacgccttcagcgactac

SEQ ID NO: 4480 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacgccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 4481 - DNA, 349 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctgcctctctactgggcctgccagggctgcgtcctaaccggcgtctgggtcatagcccacgagtgcggccaccacgccttcagcgactac

SEQ ID NO: 4482 - DNA, 346 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctaccagggctgcgtcctaaccggcgtctgggtcatagcccacgagtgcggccaccacgccttcagcgactac

SEQ ID NO: 4483 - DNA, 340 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctactctactgggcctgccagggctgcgtcctaaccggcgtctgggtcatagcccacgagtgcggccaccacgccttcagcgactac

SEQ ID NO: 4484 - DNA, 338 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactactgggcctgccaagggtgcgtcctaaccggcgtctgggtcatagcccacgagtgcggccaccacgccttcagcgactac

SEQ ID NO: 4485 - DNA, 441 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccactggtggccctcgccagccacgatggtggcaagcaggcgctggagacggtccagcggctgttgccggtgctgtgccaggcccacggcttgacccctggcctctctactgggcctgccaagggtgcgtcctaaccggcgtctgggtcatagcccacgagtgcggccaccacgccttcagcgactac

SEQ ID NO: 4486 - DNA, 342 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccagggctgcgtcctaaccggcgtctgggtcatagcccacgagtgcggccaccacgccttcagcgactac

SEQ ID NO: 4487 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcggcctctctactgggcctgccagggctgcgtcctaaccggcgtctgggtcatagcccacgagtgcggccaccacgccttcagcgactac

SEQ ID NO: 4488 - DNA, 333 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaacgctcgatccctcgctctttctcctacctcatctgggacatcatcatagcctcctgcttctactacgtcgccaccacttacttccctctcctccctcaccctctctctactgggccggccagggctgcgtcctaaccggcgtctgggtcatagcccacgagtgcggccaccacgccttcagcgactac

SEQ ID NO: 4489 - DNA, 338 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactactgggcctgccaagggtgcgtcctaacgggcctctgggtcatagcccacgagtgcggccaccacgccttcagcgactac

SEQ ID NO: 4490 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccagggctgcgtcctaacgggcctctgggtcatcgcccacgaatgcggccaccacgccttcagcgactac

SEQ ID NO: 4491 - DNA, 419 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcaggcgctgttgccggtgctgtgccaggcccacggcttgaccccccagcaggtggtggccatcgccagatggcctctctactgggcctgccaagggtgcgtcctaaccggcgtctgggtcatagcccacgagtgcggccaccacgccttcagcgactac

SEQ ID NO: 4492 - DNA, 390 bp, Artificial
  Mutation in BnaA.FAD2.a introduced by TALE nuclease pair BnFAD2_T01
caggatccatgggtgcaggtggaagaatgcaagtgtatactcactccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgctggcggtggcaagcacctgctggggggtcaagccgtgggcggcctctctactgggcctgccagggctgcgtcctaaccggcgtctgggtcatagcccacgagtgcggccaccacgccttcagcgactac

SEQ ID NO: 4493 - DNA, 332 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccaggggtgcgtcctaaccggcgtctgggtcatagcccacgagtgcggccaccacgccttcagcgactac

SEQ ID NO: 4494 - DNA, 345 bp, Artificial
  Mutation in BnaA.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccagggctgcgtcctaaccggcgtctgggtcatagcccacgagtgcggccaccacgccttcagcgactac

SEQ ID NO: 4495 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctatcctctctactgggcctgccagggctgcgtcctaaccggcgtctgggtcatagcccacgagtgcggccaccacgccttcagcgactac

SEQ ID NO: 4496 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctctcctacttcgctggcctctctactgggcctgccaagggtgcgtcctaaccggcgtctgggtcatagcccacgagtgcggccaccacgcctgcagcgactac

SEQ ID NO: 4497 - DNA, 381 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttccctcgctcgccgcagccgaacgaccgagcgcagcgtggcccctctactgggcctgccaaggctgcgtcctaaccggcgtctgggtcatagcccacgagtgcggccaccacgccttcagcgactac

SEQ ID NO: 4498 - DNA, 338 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctctctactgggcctgccaagggtgcgtcctaaccggcgtctgggtcatagcccacgagtgcggccaccacgccttcagcgactac

SEQ ID NO: 4499 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccagggctgcgtcctaaccggcgtctgggtcatagcccacgagtgcggccaccacgccttcaggactac

SEQ ID NO: 4500 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaaggctgcgtcctaacgggcctctgggtcatagcccacgagtgcggccaccacgccttcagcgactac

SEQ ID NO: 4501 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttcctctctactgggcctgccagggctgcgtcctaaccggcgtctgggtcatagcccacgagtgcggccaccacgccttcacgactac

SEQ ID NO: 4502 - DNA, 350 bp, Artificial
  Mutation in BnaA.FAD2.a introduced by TALE nuclease pair BnFAD2_T01
caggatccatgggtgcaggtggaagaatgcaagtgtctcctccatccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctccccctctctcctacttctggcctctctactgggcctgccagggctgcgtcctaaccggcgtctgggtcatagcccacgagtgcggccaccacgccttcagcgactac

SEQ ID NO: 4503 - DNA, 352 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcttcgcctggcctctctactgggcctgccagggctgcgtcctaaccggcgtctgggtcatagcccgcgagtgcggccaccacgccttcagcgactac

SEQ ID NO: 4504 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagactgaaaccgacaccatcaagcgcgtaccctgcgagacaccgcccttcactgtcggagaactcaagaaagcaatcccaccgcactgtttcaaacgctcgatccctcgctctttctcctacctcatctgggacattatcatagcctcctgcttctactacgtcgccaccacttacttccctctcctccctcaccctctctcctacttcctctctactgggcctgccagggctgcgtcctaaccggcgtctgggtcatagcccacgagtgcggccaccacgccttcagcgactac

SEQ ID NO: 4505 - DNA, 335 bp, Artificial
  Mutation in BnaA.FAD2.a introduced by TALE nuclease pair BnFAD2_T01
caggatccatgggtgcaggtggaagaatgcaagtgcatcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccaagggtgcgtcctaaccggcgtctgggtcatagcccacgagtgcgtccaccacgccgtcagcgactac

SEQ ID NO: 4506 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccatggctgcgtcctaaccggcgtctgggtcatagcccacgagtgcggccaccacgccttcagcgactac

SEQ ID NO: 4507 - DNA, 351 bp, Artificial
  Mutation in BnaA.FAD2.a introduced by TALE nuclease pair BnFAD2_T01
caggatccatgggtgcaggtgcaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctgctggcctctctactgggcctgccaagggtgcgtcctaaccggcgtctgggtcatagcccacgagtgcggccaccacgccttcagcgactac

SEQ ID NO: 4508 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgatacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctggcctctctactgggcctgccaagggtgcgtcctaaccggcgtctgggtcatagcccacgagtgcggccaccacgccttcagcgactac

SEQ ID NO: 4509 - DNA, 350 bp, Artificial
  Mutation in BnaA.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccgcctggcctctctactgggcctgccagggctgcgtcctaacgggcctctgggtcatcgcccacgaatgcggccaccacgccttcagcgactac

SEQ ID NO: 4510 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcgcagaactcaagaaagcaatcccaccgcactgtttcaaacgctcgatccctcgctctttctcctacctcatctgggccatcatcatagcctcctgcttctactacgtcgccaccacttacttccctctcctccctcaccctctctcctgcttggcctccctactgggcctgccagggctgcgtcctaacgggcctctggggcatagcccacgagtgcggccaccacgccgtcagcgactac

SEQ ID NO: 4511 - DNA, 348 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 4512 - DNA, 348 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcgcctctctactgggcctgccagggctgcgtcctaaccggcgtctgggtcatagcccacgagtgcggccaccacgccttcagcgactac

SEQ ID NO: 4513 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgcctgcagcgactac

SEQ ID NO: 4514 - DNA, 417 bp, Artificial
  Mutation in BnaA.FAD2.a introduced by TALE nuclease pair BnFAD2_T01
caggatccatgggtgcaggaggaagaatgcaagtgactcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtcaggacatgatcgcagcgttgccagagcgagattctccgcgctgtagaagtcaccattgttgtgctggcctctctactgggcctgccagggctgcgtcctaaccggcgtctgggtcatagcccacgagtgcggccaccacgccttcagcgactac

SEQ ID NO: 4515 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaacgggcctctgggtcatagtccacgagtgcggccaccacgccttcagcgactac

SEQ ID NO: 4516 - DNA, 352 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacccccctggcctctctactgggcctgccagggctgcgtcctaaccggcgtctgggtcatagcccacgagtgcggccaccacgccttcagcgactac

SEQ ID NO: 4517 - DNA, 346 bp, Artificial
  Mutation in BnaA.FAD2.a introduced by TALE nuclease pair BnFAD2_T01
caggatccatgggtgcaggtggaagaatgcaagtgtctcctccatccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccagggctgcgtcctaaccggcgtctgggtcatagcccacgagtgcggccaccacgccttcagcgactac

SEQ ID NO: 4518 - DNA, 355 bp, Artificial
  Mutation in BnaA.FAD2.a introduced by TALE nuclease pair BnFAD2_T01
caggatccatgggtgcaggtggaagaatgcaagtgtctccttccttcaaaaagtctgaaaccgacaacatcaagcgcgtaccctgcgagacaccgcccttcactgtcggagaactcaagaaagcaatcccaccccactgcttcaaacgctcgatccctcgctctttctcctacctcatctgggccatcatcatagcctcctgcttctactacgtcgccaccacttacttctctctcctccctcaccctctctcctacctcgcccccggcctctctactgggcctgccaagggtgcgtcctaaccggcgtctgggtcatagcccacgagtgcggccaccacgccttcagcgactac

SEQ ID NO: 4519 - DNA, 334 bp, Artificial
  Mutation in BnaA.FAD2.a introduced by TALE nuclease pair BnFAD2_T01
caggatccatgggtgcaggtagaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccacctcttacttccctctcctccctcaccctctctcctacttcgctgccaagggtgcgtcctaaccggcgtctggggcatagcccacgagtgcggccaccacgcctgcagcgactac

SEQ ID NO: 4520 - DNA, 357 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccacactgtttcaaacgctcgatccctcgctctttctcctacctcatctgggacatcatcatagcctcctgcttctactacgtcgccaccacttacttccctctcctccctcaccctctctcctacttcgcgcgcctggcctctctactgggccggccagggctgcgtcctaaccggcgtctgggtcatagcccacgagtgcggccaccacgccttcagcgactac

SEQ ID NO: 4521 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccagggctgcgtcctaacgggcctctgggtcatcgcccacgaatgcggccaccacgccttcagcgactac

SEQ ID NO: 4522 - DNA, 340 bp, Artificial
  Mutation in BnaA.FAD2.a introduced by TALE nuclease pair BnFAD2_T01
caggatccatgggtgcaggtggaagaatgcaagtgtctactcactacaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccaagggtgcggcctaaccggcgtctgggtcatagcccacgagtgcggccaccacgccttcagcgactac

SEQ ID NO: 4523 - DNA, 345 bp, Artificial
  Mutation in BnaA.FAD2.a introduced by TALE nuclease pair BnFAD2_T01
caggatccatgggtgcaggtggcagaatgcaagtgtctactccctccaaaaagtctgaaaccgacaacatcaagcgcgtaccctgcgagacacagcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccaagggtgcgtcctaaccggcgtctgggtcatagcccacgagtgcggccaccacgcctgcagcgactac

SEQ ID NO: 4524 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccagggctgcgtactaaccggcgtctgggtcatagcccacgagtgcggccaccacgccttcagcgactac

SEQ ID NO: 4525 - DNA, 350 bp, Artificial
  Mutation in BnaA.FAD2.a introduced by TALE nuclease pair BnFAD2_T01
caggatccatgggtgcaggtggcagaatgcaagtgtctcctccatccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcttctggcctctctactgggcctgccagggctgcgtcctaaccggcctctgggtcatagcccacgagtgcggccaccacgccttcagcgactac

SEQ ID NO: 4526 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctctctactgggccggccagggctgcgtcctaaccggcgtctgggtcatagcccacgagtgcggccaccacgccttcagcgactac

SEQ ID NO: 4527 - DNA, 335 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaatcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcctctctactgggcctgccagggctgcgtcctaaccggcgtctgggtcatagcccacgagtgcggccaccacgccttcagcgactac

SEQ ID NO: 4528 - DNA, 346 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccagggctgcgtcctaaccggcgtctgggttatagcccacgagtgcggccaccacgccttcagcgactac

SEQ ID NO: 4529 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacacagcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 4530 - DNA, 308 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccacccttcactctcggagacctcaagaaagcaatcccacctcactgcttcaaacgctccatccctcgctccttctcctacctcctcttcgacatcctcgtctcctcctccctcaccctctctcctacttctctctactgggcctgccaagggtgcgtcctaaccggcgtctgggtcatagcccacgagtgcggccaccacgccttcagcgactac

SEQ ID NO: 4531 - DNA, 340 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttactgggcctgccagggctgcgtcctaaccggcgtctgggtcatagcccacgaatgcggccaccacgccttcagtgactac

SEQ ID NO: 4532 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgcctggcctctactgggcctgccaagggtgcgtcctaaccggcgtctgggtcatagcccacgagtgcggccaccacgccttcagcgactac

SEQ ID NO: 4533 - DNA, 342 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccagggctgcgtcctaaccggcgtctgggtcatagcccacgagtgcggccaccacgccttcagcgactac

SEQ ID NO: 4534 - DNA, 344 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctggcctctctactgggcctgccagggctgcgtcctaaccggcgtctgggtcatagcccacgagtgcggccaccacgccttcagcgactac

SEQ ID NO: 4535 - DNA, 341 bp, Artificial
  Mutation in BnaA.FAD2.a introduced by TALE nuclease pair BnFAD2_T01
caggatccatgggtgcaggtggaagaatgcaagtttctccttcctccaagaagtctgaaaccgacaacatcaagcgcgtaccctgtgagacaccgcccttcactgtcggagaactcaagaaagcaatcccaccgcactgtttcaaacgctcgatccctcgctctgtctcctacctcctcttcgacatcctcgtctcctcctccctctaccacctctccacagcctacttccctctcctccccctccctctctggcctctctactgggcctgccagggctgcgtcctaaccggcgtctgggtcatagcccacgagtgcggccaccacgccttcagcgactac

SEQ ID NO: 4536 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctatcgcctagcctctctactgggcctgccagggctgcgtcctaaccggcgtctgggtcatagcccacgagtgcggccaccacgccttcagcgactac

SEQ ID NO: 4537 - DNA, 348 bp, Artificial
  Mutation in BnaA.FAD2.a introduced by TALE nuclease pair BnFAD2_T01
caggatccatgggtgcaggtggaagaatgcaagtatctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccgcctggcctctctactgggcctgccaagggtgcgtcctaatcggcgtctgggtcatagcccacgagtgcggccaccacgccttcagcgactac

SEQ ID NO: 4538 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctgggcctctctactgggcctgccaagggtgcgtcctaacgggcctctgggtcatcgcccacgagtgcggccaccacgccttcagcgactac

SEQ ID NO: 4539 - DNA, 434 bp, Artificial
  Mutation in BnaA.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcggctgttgccggtgctgtgccaggcccacggcttgaccccccagcaggtggtggccatcgccagcaatggcggtggcaagcaggcgctggaggcctggcctctctactgggcctgccagggctgcgtcctaaccggcgtctgggtcatagcccacgagggcggccaccacgccttcagcgactac

SEQ ID NO: 4540 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcaacgactac

SEQ ID NO: 4541 - DNA, 321 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcaagggtgcgtcctaaccggcgtctgggtcatagcccacgagtgcggccaccacgccttcagcgactac

SEQ ID NO: 4542 - DNA, 339 bp, Artificial
  Mutation in BnaA.FAD2.a introduced by TALE nuclease pair BnFAD2_T01
caggatccatgggtgcaggtggaagaatgcaagtgtctcctccctcccagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttactgggccggccagggctgcgtcctaaccggcgtctgggtcatagcccacgagtgctgccaccacgccttcagcgactac

SEQ ID NO: 4543 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccacctcactgcttcaaacgctccatcccacgctccttctcctcttcgacatcatcatctcctcctcggctcctccctctaccacctctccacagcctacttccctctcctccctcaccctctctcctactctactgggcctgccagggctgcgtcctaaccggcgtctgggtcatagcccacgagtgcggccaccacgccttcagcgactac

SEQ ID NO: 4544 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgtgagacaccgcctttcactgtcggagaactcaagaaagcaatcccaccgcactgtttcaaacgctcgatccctcgctctttctcctacctcatctgggacatcatcatagcctcctgcttctactacgtcgccaccacttacttccctcccctccctcaccctctctcctgcattggcctctctactgggcctgccaaggctgcgtcctaacgggcgtctgggtcatagcccacgagtgcggccaccacgccttcagcgactac

SEQ ID NO: 4545 - DNA, 338 bp, Artificial
  Mutation in BnaA.FAD2.a introduced by TALE nuclease pair BnFAD2_T01
caggatccatgggtgcaggtggaagaatgcaagtgtctcctccatccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctatcctactactgggcctgccaagggtgcgtcctaacgggcctctgggtcatagcccacgagtgcggccaccacgccttcagcgactac

SEQ ID NO: 4546 - DNA, 430 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttatgtacggccagcaacgtcggttcgagatggcgctcgatgccgccaacgatggccaccacctgctccggggtcaagccagttggcctctctactgggcctgccagggctgcgtcctaacgggcctctgggtcatcgcccacgaatgcggccaccacgcctgcagcgactac

SEQ ID NO: 4547 - DNA, 335 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctcctctctactgggcctgccagggctgcgtcctaaccggcgtctgggtcatagcccacgagtgcggccaccacgccttcagcgactac

SEQ ID NO: 4548 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagaccccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaaggctgcgtcctaacgggcctctgggtcatagcccacgagtgcggccaccacgccttcagcgactac

SEQ ID NO: 4549 - DNA, 341 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgggcctgccagggctgcgtcctaaccggcgtctgggtcatagcccacgagtgcggccaccacgccttcagctactac

SEQ ID NO: 4550 - DNA, 348 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 4551 - DNA, 403 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggatacctgtccgcctttctccctgcgggaagcgtggcgctttctcatagctcaggcctctctactgggcctgccaagggtgcgtcctaaccggcgtctgggtcatagcccacgagtgcggccaccacgcctgcagcgactac

SEQ ID NO: 4552 - DNA, 424 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacggtgccaggcccacggcttgaccccggagcaggtggtggccatcgccagccacgatggcggcaagcaggcgctggactggcctctctactgggcctgccagggctgcgtcctaaccggcgtctgggtcatagcccacgagtgcggccaccacgccttcagcgactac

SEQ ID NO: 4553 - DNA, 348 bp, Artificial
  Mutation in BnaA.FAD2.a introduced by TALE nuclease pair BnFAD2_T01
caggatccatgggtgcaggtggaagaatgcaagtgtctcctacctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacttggcctctctactgggcctgccaagggtgcgtcctaaccggcgtctgggtcatagcccacgagtgcggccaccacgccttcagcgactac

SEQ ID NO: 4554 - DNA, 339 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttccttccctctcctccctcaccctctctcctctctactgggcctgccagggctgcgtcctaaccggcgtctgggtcatagcccacgagtgcggccaccacgccttcagcgactac

SEQ ID NO: 4555 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaggagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacaggcctctctactgggcctgccagggctgcgtcctaacgggcctctgggtcatcgcccacgaatgcggccaccacgccttcagcgactac

SEQ ID NO: 4556 - DNA, 346 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgagtgcggccaccacgccttcagcgactac

SEQ ID NO: 4557 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccagggctgcgtcctaaccggcgtctgggtcatagcccacgagtgcggccaccacgccttcagcgactac

SEQ ID NO: 4558 - DNA, 347 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccagggctgcgtcctaacgggcctctgggtcatcgcccacgaatgcggccaccacgccttcagcgactac

SEQ ID NO: 4559 - DNA, 349 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctcctgtgcctgccaagggtgcgtcctaacgggcctctgggtcatagcccacgagtgcggcccccccgccttcagcgactac

SEQ ID NO: 4560 - DNA, 343 bp, Artificial
  Mutation in BnaA.FAD2.a introduced by TALE nuclease pair BnFAD2_T01
aaggatccatgtgtgcaggtggaagaatgcaagtgtatagtcactcaaaaaagtctgaaaccgacaacatcaagcgcgtaccctgcgagacaccgcacttcactgtcggagaactcaagaaagcaatcccaccgcactgtttcaaactctcgatccctcgctctttctcctacctcatctgggacataatcatagcctcctgcttctactacgtcgccaccacttacttccctctcctccctcaccctctctcctacttctctactgggcctgccagggctgcgtcctaaccggcgtctgggtcatagcccacgagggcggccaccacgccttcagcgactac

SEQ ID NO: 4561 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccagggctgcgtcctaacgggcctctgggtcatagcccacgagtgcggccaccacgccttcagcgactac

SEQ ID NO: 4562 - DNA, 450 bp, Artificial
  Mutation in BnaA.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttcgaaaacggcttgtcccgcgtcatcggcgggggtcataacgtgactcccttaaggcagtgcatgcatggcgcaatgcactgacgggtgccccgctcaactttggcctctctactgggcctgccagggctgcgtcctaacctgcgtctgggtcatagcccacgagtgcggccaccacgccttcagcgactac

SEQ ID NO: 4563 - DNA, 351 bp, Artificial
  Mutation in BnaA.FAD2.a introduced by TALE nuclease pair BnFAD2_T01
caggagccatgggtgcaggtggcagaatgcaagtgtctcctccatccaaaaagcctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccaagggtgcgtcctaaccggcgtctgggtcatagcccacgagtgcggccaccacgccttcagcgactac

SEQ ID NO: 4564 - DNA, 349 bp, Artificial
  Mutation in BnaA.FAD2.a introduced by TALE nuclease pair BnFAD2_T01
caggatccatgggtgcaggtggaagaatgcaagtgtctcctccctcccaaaagtctgaaaccgacaacatcaagcgcgtaccctgcgagacaccgcccttcactgtcggagaactcaagaaagcaatcccaccgcactgtttcaaactctcgatccctcgctctttctcctacctcatctgggacatcatcatagcctcctgcttctactacgtcgccaccacttacttccctctcctccctcaccctctctcctacttcggcctctctactgggcctgccagggctgcgtcctaacgggcctctgggtcatagcccacgagtgcggccaccacgccttcagcgactac

SEQ ID NO: 4565 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagcctgaaaccgacaacctcaaacgcgtaccctgcgagacaccgcccttcactgtcggagaactcaagaaagcaatcccaccgcactgtttcaaacgctcgatccctcgctctttctcctacctcatctgagacatcatcctagcctcctgcttctactccgtcgccaccacttacttccctctcctccctcaccccccctcccccttcgactgggcctgccagggctgcgtcctaacgggcctctgggtcatagcccacgagtgcggccaccacgccttcagcgactac

SEQ ID NO: 4566 - DNA, 321 bp, Artificial
  Mutation in BnaA.FAD2.a introduced by TALE nuclease pair BnFAD2_T01
caggatccatgggtgcaggtggaagaatgcaagtgtctcctccctccaaaaagcctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcacaagggtgcgtcctaaccggcgtctgggtcatagcccacgagtgcggccaccacgccttcagcgactac

SEQ ID NO: 4567 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctcgttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 4568 - DNA, 348 bp, Artificial
  Mutation in BnaA.FAD2.a introduced by TALE nuclease pair BnFAD2_T01
caggatccatgggtgcaggtggaagaatgcaagtgactcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccaggcctgcagcgactac

SEQ ID NO: 4569 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcacaccgcactgtttcaaacgctcgatccctcgctctttctcctacctcatctgggacatcatcatagcctcctgcttctactacgtcgccaccacttacttccctctcctccctcaccctctctcctgcctctctactgggcctgccagggctgcgtcctaaccggcgtctgggtcatagcccacgagtgcggccaccacgccttcagcgactac

SEQ ID NO: 4570 - DNA, 441 bp, Artificial
  Mutation in BnaA.FAD2.a introduced by TALE nuclease pair BnFAD2_T01
caggatccatgggtgcaggtggaagaatgcaagtctctcctcccttcagctcccccggaaccaacaccctcaaacgcgtcccctgcgagacaccacccctcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctcccccgctggtggccctcgccggccacgatggtggcaagcaggcgctggagacggtccagcggctgttgccggtgctgtgccaggcccacggcttgacccctggcctctctactgggcctgccagggctgcggcctaacgggcctctgggtcatcgcccacgaatgcggccaccacgccttcagcgactac

SEQ ID NO: 4571 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaaggctgcgtcctaacgggcctctgggtcatagcccacgagtgcggccaccacgccttcagcgactac

SEQ ID NO: 4572 - DNA, 344 bp, Artificial
  Mutation in BnaA.FAD2.a introduced by TALE nuclease pair BnFAD2_T01
caggagggtgcaggtggacgaatgcaagtgtctcctccctccaaaacgtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgaatgcggccaccacgccttcagcgactac

SEQ ID NO: 4573 - DNA, 346 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgcttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgagtgcggccaccacgccttcagcgactac

SEQ ID NO: 4574 - DNA, 418 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccccccccctctcccttagccgtagttaggccaccacttcaagaactctgtagcaccgcctacatacctcgctctgctaatcctgttacctggcccctctactgggcctgccaaggctgcgtcctaacgggcctctgggtcatcgcccacgaatgcggccaccacgccttcagcgactac

SEQ ID NO: 4575 - DNA, 325 bp, Artificial
  Mutation in BnaA.FAD2.a introduced by TALE nuclease pair BnFAD2_T01
caggatccatgggtgcaggtggaagaatgcaagtgtctcctccctccaaaaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacttggctgcgtcctaaccggcgtctgggtcatagcccacgagtgcggccaccacgccttcagcgactac

SEQ ID NO: 4576 - DNA, 338 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccctctctactgggcctgccaagggtgcgtcctaaccggcgtctgggtcatagcccacgagtgcggccaccacgccttcagcgactac

SEQ ID NO: 4577 - DNA, 346 bp, Artificial
  Mutation in BnaA.FAD2.a introduced by TALE nuclease pair BnFAD2_T01
caggatccatgggtgcaggtggaagaatgcaagtgtctcctcactccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcctctctactgggcctgccagggctgcgtcctaaccggcgtctgggtcatagcccacgagtgcggccaccacgccttcagcgactac

SEQ ID NO: 4578 - DNA, 334 bp, Artificial
  Mutation in BnaA.FAD2.a introduced by TALE nuclease pair BnFAD2_T01
caggatccatgggtgcaggtggaagaatgcaagtgtctcctccctccaaaaagactgaaacgtacaacatcaaactcggaccctgcgagacaccgcccttcactgtcggagaactcaagaaagcaatcccaccgcactgtttcaaacgctcgatccctcgctctttctcctacctcatctgggacatcatcatcgcctcctgcttcgactacgtcgccaccacttacttccctctcctccctcacccactctctactgggcctgccagggctgcgtcctaaccagcgtctgggtcatagcccacgagtgcggccgccacgccttcagcgactac

SEQ ID NO: 4579 - DNA, 426 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttatggacgccaactacctctgatagttgagtcgatacttcggcgatcaccgcttccctcataatgtttaactttgttttggcctctctactgggccggccagggctgcgtcctaaccggcgtctgggtcagagcccacgagtgcggccaccacgccttcagcgactac

SEQ ID NO: 4580 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctcggcctctctactcggcctgccagggctgcgtcctaaccggcgtctgggtcatagccctccagggcggctaccacgccttcagcccctac

SEQ ID NO: 4581 - DNA, 348 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 4582 - DNA, 347 bp, Artificial
  Mutation in BnaA.FAD2.a introduced by TALE nuclease pair BnFAD2_T01
caggatccatgggtgcagggggaagaatgcaagtgtctcctcccttccagaagtctgaaaccgacaccatcaagcgcgtaccctgcgagacaccgcccttcactgtcggagaactcaagaaagcactcccaccgcactgtttcaaacgctcgatccctcgctctttctcctacctcatctgggacatcatcatagcctcctgcttctactacgtcgccaccacttacttccctctcctccctcaccctctctcctaatggcctctctaccgggccggccagggctgcgtcctaaccggcgtctgggtcagagcccacgagggcggccaccacgccatcagcgactac

SEQ ID NO: 4583 - DNA, 335 bp, Artificial
  Mutation in BnaA.FAD2.a introduced by TALE nuclease pair BnFAD2_T01
caggatccatgggtgcagttggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccagggctgcgtcctaaccggcgtctgggtcatagcccacgagtgcggccaccacgccttcagcgactac

SEQ ID NO: 4584 - DNA, 333 bp, Artificial
  Mutation in BnaA.FAD2.a introduced by TALE nuclease pair BnFAD2_T01
caggatccatgggtgcaggtgaaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccagggctgcctcctaaccggcgtctgggtcatagcccacgagtgcggccaccgcgccttcacgactac

SEQ ID NO: 4585 - DNA, 355 bp, Artificial
  Mutation in BnaA.FAD2.a introduced by TALE nuclease pair BnFAD2_T01
catgatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccagggctgcgtcctaaccggcgtctgggtcatagcccacgagtgcggccaccacgccttcagcgactac

SEQ ID NO: 4586 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctttcctggcctctctactgggcctgccagggctgcgtcctaaccggcgtctgggtcatagcccacgaatgcggccaccacgccttcagcgactac

SEQ ID NO: 4587 - DNA, 349 bp, Artificial
  Mutation in BnaA.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccagggctgcgtcctaaccggcgtctgggtcatagcccacgagtgcggccaccacgccttcagcgactac

SEQ ID NO: 4588 - DNA, 350 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctttactgggcctgccaagggtgcgtcctaaccggcgtctgggtcatagcccacgagtgcggccaccacgccttcagcgactac

SEQ ID NO: 4589 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctctctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgagtgcggccaccacgccttcagcgactac

SEQ ID NO: 4590 - DNA, 332 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcataccctcctgcttctactacgtcgccaccacttacttccctctcctccctcaccctctctactgggcctgccagggctgcgtcctaaccggcgtctggctcatagcccacgagtgcggccaccacgccttcaccgactac

SEQ ID NO: 4591 - DNA, 332 bp, Artificial
  Mutation in BnaA.FAD2.a introduced by TALE nuclease pair BnFAD2_T01
caggatccatggttgcagctggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggaactgccaagggggcggcctaaccggcgtctggctcatagcccacgagtgctgtcaccacgccttcagcgactac

SEQ ID NO: 4592 - DNA, 398 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgccaacttctcaagattgcaaaacgtggcggcgtgaccgcagtggaggcagtgcatgcgcctctctactgggcctgccaaggctgcgtcctaacgggcctctgggtcatagcccacgagtgcggccaccacgccttcagcgactac

SEQ ID NO: 4593 - DNA, 356 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaaggctgcgtcctaacgggcctctgggtcatcgcccacgaatgcggccaccacgccttcagcgactac

SEQ ID NO: 4594 - DNA, 343 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttctctactgggcctgccagggctgcgtcctaaccggcgtctgggtcatagcccacgagtgcggccaccacgccttcagcgactac

SEQ ID NO: 4595 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccctggcctctctactgggcctgccagggctgcgtcctaaccggcggctgggtcatagcccacgagggcggccaccacgccttcagcgacta

SEQ ID NO: 4596 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccccggcctctctactggtcctgccagggctgcgtcctaaccggcgtctgggtcatcgcccacgaatgcggccaccacgccttcagcgactac

SEQ ID NO: 4597 - DNA, 386 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggccaccgcctgctggggggtcaagccgtgggcctggcacagtctctactgggcctgccagggctgcgtcctaaccggcgtctgggtcatagcccacgagtgcggccaccacgccttcagcgactac

SEQ ID NO: 4598 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctggcctctctactgggtctgccaagggtgcgtcctaaccggcgtctgggtcatagcccacgagtgcggccaccacgccttcagcgactac

SEQ ID NO: 4599 - DNA, 349 bp, Artificial
  Mutation in BnaA.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgctggcctctctactgggcctgccagggctgcgtcctaaccggcgtctgggtcatagcccacgagtgcggccaccacgccttcagcgactac

SEQ ID NO: 4600 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaattccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgccttcagcgactac

SEQ ID NO: 4601 - DNA, 337 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattactgggcctgccagggctgcgtcctaaccggcgtctgggtcatagcccacgagtgcggccaccacgccttcagcgacac

SEQ ID NO: 4602 - DNA, 340 bp, Artificial
  Mutation in BnaA.FAD2.a introduced by TALE nuclease pair BnFAD2_T01
caggatcatgggtgcaggtggaagaatgcaagtgtctcctccctctaaaaagtatgaaaccgacaacatcaagcgagtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctctactgggccggccaaggctgcgtcctaacgtgcctctgggtcatcgcccacgaatgctgccgctactcctgcagcgactac

SEQ ID NO: 4603 - DNA, 350 bp, Artificial
  Mutation in BnaA.FAD2.a introduced by TALE nuclease pair BnFAD2_T01
caggatccatgggtgcaggtggaagaatgcaagtgtctcctccatccaaaaagtctgaaaccgacaacatcaagagcgtaccctgcgagacaccgcccttcactgtcggagaactcaagaaagcaattccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 4604 - DNA, 352 bp, Artificial
  Mutation in BnaA.FAD2.a introduced by TALE nuclease pair BnFAD2_T01
caggatccatgggtgcaggtggaagaatgcaagtgtctcctcccttcaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccgccctggcctctctactgggcctgccagggctgcgtcctaaccggcgtctgggtcatagcccacgagtgcggccaccacgccttcagcgactac

SEQ ID NO: 4605 - DNA, 343 bp, Artificial
  Mutation in BnaA.FAD2.a introduced by TALE nuclease pair BnFAD2_T01
caggatccatgggtgcaggtggaagaatgcaagtgtctactccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccagggctgcgtcctaaccggcgtctgggtcatagcccacgagtgcggccaccacgccttcagcgactac

SEQ ID NO: 4606 - DNA, 354 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggtggcctctctactgggcctgccagggctgcgtcctaaccggcgtctgggtcatagcccacgagtgcgtccaccacgcctgcagcgactac

SEQ ID NO: 4607 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacctctctactgggcctgccaagggtgcgtcctaaccggcgtctgggtcatagcccacgagtgcggccaccacgccttcagcgactac

SEQ ID NO: 4608 - DNA, 341 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctggcctctctactgggcctgccagggctgcgtcctaaccggcgtctgggtcatagcccacgagtgcggccaccacgccttcagcgactac

SEQ ID NO: 4609 - DNA, 348 bp, Artificial
  Mutation in BnaA.FAD2.a introduced by TALE nuclease pair BnFAD2_T01
caggccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 4610 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcctctgggtcatagcccacgagtgcggccaccacgccttcagcgactac

SEQ ID NO: 4611 - DNA, 354 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttcgcctggcctctctactgggcctgccaagggtgcgtcctaaccggcgtctgggtcatagcccacgaatgcggccaccacgccttcagtgactac

SEQ ID NO: 4612 - DNA, 358 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgccgggtctggcctctctactaggcctgccagggctgcgtcctaaccggcgtctgggtcatagcccacgagtgcggccaccacgccttcagcgactac

SEQ ID NO: 4613 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcgaacgctcgatccctcgctctttctcctacctcatctgggacatcatcatagcctcctgcttctactacgtcgccaccacttacttccctctcctccctcaccctctctcctacttcgctggcctctctactgggcctgccagggctgcgtcctaaccggcgtctgggtcatagcccacgagtgcggccaccacgccttcagcgactac

SEQ ID NO: 4614 - DNA, 335 bp, Artificial
  Mutation in BnaA.FAD2.a introduced by TALE nuclease pair BnFAD2_T01
caggatccatgggtgcaggtggcagaatgcaagtgtctcctccctcaaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccaaggctgcgtcctaacgggcctctgggtcatagcccacgagtgcggccaccacgccttcagcgactac

SEQ ID NO: 4615 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagcctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttcgctggcctctctactgggcctgccaagggtgcgtcctaaccggcgtctgggtcatagcccacgagtgcggccaccacgccttcagcgactac

SEQ ID NO: 4616 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctggtctctctactgggcctgccagggctgcgtcctaaccggcgtctgggtcatagcccacgagtgcggccaccacgccttcagcgactac

SEQ ID NO: 4617 - DNA, 398 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgccttggcaacgctgcgatcatgtcctgatacttgacagcgacggtccctggcctctctactgggcctgccagggctgcgtcctaaccggcgtctgggtcatagcccacgagtgcggccaccacgccttcagcgactac

SEQ ID NO: 4618 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaacctgcgtctgggtcatagcccacgagtgcggccaccacgccttcagcgactac

SEQ ID NO: 4619 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccctggcctctctactgggcctgccagggctgcgtcctaaccggcgtctgggtcatagcccacgagtgcggccaccacgccttcagcgactac

SEQ ID NO: 4620 - DNA, 339 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcgcttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccggcctgctagggctgcgtcctaaccggcgtctgggtcatagcccacgagtgcggccaccacgccttcagcgactac

SEQ ID NO: 4621 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcaatccctcgctctttctcctacctcatctgggacatcatcatagcctcctgcttctactacgtcgccaccacttacttccctctcctccctcaccctctctcctacttcggcctctctactgggcctgccagggctgcgtcctaaccggcgtctgggtcatagcccacgagtgcggccaccacgccttcagcgactac

SEQ ID NO: 4622 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaaggctgcgtcctaacgggcctctgggtcatcgcccacgaatgcggccaccacgccttcagcgactac

SEQ ID NO: 4623 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcatctgggacatcatcatagcctcctgcttctactacgtcgccaccacttacttccctctcctccctcaccctctctcctatcctctctactgggcctgccagggctgcgtcctaaccggcgtctgggtcatagcccacgagtgcggccaccacgccttcagcgactac

SEQ ID NO: 4624 - DNA, 348 bp, Artificial
  Mutation in BnaA.FAD2.a introduced by TALE nuclease pair BnFAD2_T01
caggatccatgggtgcaggtgcaagaatgcaagtctctcctccctccagctcccccgaaaccaaaaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 4625 - DNA, 345 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccagggctgcgtcctaaccggcgtctgggtcatagcccacgagtgcggccaccacgccttcagcgactac

SEQ ID NO: 4626 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctggtacatcatcatagcctcctgcttctactacgtcgccaccacttacttccctctcctccctcaccctctctcctacttcgcccctggcctctctactgggcctgccagggctgcgtcctaaccggcgtctgggtcatagcccacgagtgcggccaccacgccttcagcgactac

SEQ ID NO: 4627 - DNA, 348 bp, Artificial
  Mutation in BnaA.FAD2.a introduced by TALE nuclease pair BnFAD2_T01
caggatccatgggtgcaggtggaagaatgcaagtgtctcctcactccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaaccggcgtctgggtcatagcccacgagtgcggccaccacgccttcagcgactac

SEQ ID NO: 4628 - DNA, 347 bp, Artificial
  Mutation in BnaA.FAD2.a introduced by TALE nuclease pair BnFAD2_T01
caggatccatgggtgcaggtggaagaatgcaagtgtctcatccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccagggctgcgtcctaaccggcgtctgggtcatagcccacgagtgcggccaccacgccttcagcgactac

SEQ ID NO: 4629 - DNA, 352 bp, Artificial
  Mutation in BnaA.FAD2.a introduced by TALE nuclease pair BnFAD2_T01
caggatccatgggtgcaggtggcagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggcctctctactgggcctgccagggctgcgtcctaaccggcgtctgggtcatagcccacgagtgcggccaccacgccttcagcgactac

SEQ ID NO: 4630 - DNA, 343 bp, Artificial
  Mutation in BnaA.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccagggctgcgtcctaaccggcgtctgggtcatagcccacgagtgcggccaccacgccttcagcgactac

SEQ ID NO: 4631 - DNA, 346 bp, Artificial
  Mutation in BnaA.FAD2.a introduced by TALE nuclease pair BnFAD2_T01
caggatccatgggtgcaggtggaagaatgcaagtgtctcctccctcacagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccagggctgcgtcctaaccggcgtctgggtcatagcccacgagtgcggccaccacgccttcagcgactac

SEQ ID NO: 4632 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgtggcctctctactgggcctgccagggctgcgtcctaaccggcgtctgggtcatagcccacgagtgcggccaccacgcctgcagcgactac

SEQ ID NO: 4633 - DNA, 342 bp, Artificial
  Mutation in BnaA.FAD2.a introduced by TALE nuclease pair BnFAD2_T01
caggatcctgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgccttcagcgactac

SEQ ID NO: 4634 - DNA, 339 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctggcctctctactgggcctgccaagggtgcgtcctaaccggcgtctgggtcatagcccacgagtgcggccaccacgccttcagcgactac

SEQ ID NO: 4635 - DNA, 349 bp, Artificial
  Mutation in BnaA.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgttggcctctctactgggcccgccagggccgcggcctaaccggcgtctgggtcatagcccacgagtgcggccaccacgccttcagcaactac

SEQ ID NO: 4636 - DNA, 354 bp, Artificial
  Mutation in BnaA.FAD2.a introduced by TALE nuclease pair BnFAD2_T01
caggatccatgggtgcaggtggaagaatgcaagtgtctcctccctccaaaaagactgaaaccgacaacatcaagcgcgtaccctgcgagacaccgcccttcactgtcgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttcgcctggcctctctactgggcctgccaagggtgcgtcctaaccggcgtctgggtcatagcccacgagtgcggccaccacgccttcagcgactac

SEQ ID NO: 4637 - DNA, 386 bp, Artificial
  Mutation in BnaA.FAD2.a introduced by TALE nuclease pair BnFAD2_T01
caggatccatgggtgcaggtggcagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttcccctacctcatctgggacatcatcatagcctcctgcttctactacgtcgccaccacttacttccctctcctccctcaccctctcccctacttggccaccacctgctggggggtcaagccgtgggcctggcacagtctctactgggcctgccagggctgcgtcctaaccggcgtctgggtcatagcccacgagtgcggccaccacgccttcagcgactac

SEQ ID NO: 4638 - DNA, 342 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctgtctctctactgggcctgccagggctgcgtcctaaccggcgtctgggtcatagcccacgagtgcggccaccacgccttcagcgactac

SEQ ID NO: 4639 - DNA, 340 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccagggctgcgtcctaacgggcctctgggtcacagcccacgagtgcggccaccacgccttcagcgactac

SEQ ID NO: 4640 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtaggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatcctctctactgggccggccagggctgcgtcctaaccggcgtctgggtcatagcccacgagtgcggccaccacgcattcagcgactac

SEQ ID NO: 4641 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccccacctctctactgggcctgccagggctgcgtcctaaccggcgtctgggtcatagcccacgagtgcggccaccacgccttcagcgactac

SEQ ID NO: 4642 - DNA, 332 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacactgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccaagggtgcgtcctaaccggcgtctgggtcatagcccacgagtgcggccaccacgccttcagcgactac

SEQ ID NO: 4643 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcctctctactgggcctgccagggctgcgtcctaaccggcgtctgggtcatagcccacgagtgcggccaccacgccttcagcgactac

SEQ ID NO: 4644 - DNA, 340 bp, Artificial
  Mutation in BnaA.FAD2.a introduced by TALE nuclease pair BnFAD2_T01
caggatccatgggtgcaggttgaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccagggctgcgtcctaaccggcgtctgggtcatagcccacgagtgcggccaccactccttcagcgactac

SEQ ID NO: 4645 - DNA, 347 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcctagcctcctgcttctactacgtcgccaccacttacttccctctcctccctcaccctctcccctacaggcctctctactgggcctgccagggctgcgtcctaaccggcgtctgggtcatagcccacgagtgcggccaccacgccttcagcgactac

SEQ ID NO: 4646 - DNA, 349 bp, Artificial
  Mutation in BnaA.FAD2.a introduced by TALE nuclease pair BnFAD2_T01
caggatccatgggtgcaggtggcagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcactctttctcctacctcatctgggacatcatcatagcctcctgcttctactacgtcgccaccacttacttccctctcctccctcaccctctctcctactctggcctctctactgggcctgccaagggtgcgtcctaaccggcggctgggtcatagcccacgagtgcggccaccacgccttcagcgactac

SEQ ID NO: 4647 - DNA, 350 bp, Artificial
  Mutation in BnaA.FAD2.a introduced by TALE nuclease pair BnFAD2_T01
caggatccatgggtgcaggtggaagaatgcaagtgtctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 4648 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgccctgtttcaaacgctcgatccctcgctctttctcctcttcgacatcatcatctcctcctcggctcctccctctaccacctctccacagcctacttccctctcctcccccaccctctcccttacctcgcctctactgggcctgccaaggctgcgtcctaacgggcctctgggtcatcgcccacaaatgcggccaccacgccttcagcgactac

SEQ ID NO: 4649 - DNA, 348 bp, Artificial
  Mutation in BnaA.FAD2.a introduced by TALE nuclease pair BnFAD2_T01
caggatccatgggtgcaggtggcagaatgcaagtgtctcctccctccaaaaagcctgaaaccgacaacatcaagcgcgtaccctgcgagacaccgcccttcactgtcggagaactcaagaaagcaatccaccgcactgtttcaaacgctcgatccctcgctctttctcctacctcatctgggacatcatcatagcctcctgcttctactacgtcgccaccacttacttccctctcctccctcaccctctctcctaccttggcctctctactgggcctgccagggctgcgtcctaaccggcgtctgggtcatagcccacgagtgcggccaccacgcctgcagcgactac

SEQ ID NO: 4650 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcccctggcctctctactgggcctgtcaagggtgcgtcctaaccggcgtctgggtcatagcccacgagtgcggccaccacgccttcagcgactac

SEQ ID NO: 4651 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccacttcgcctggcctctctactgggcctgccagggctgcgtcctaaccggcgtctgggtcatagcccacgagtgcggccaccacgccttcagcgactac

SEQ ID NO: 4652 - DNA, 329 bp, Artificial
  Mutation in BnaA.FAD2.a introduced by TALE nuclease pair BnFAD2_T01
caggatccattggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgggcctgccagggctgcgtcctaaccggcgtctgggtcatagcccacgagtgcggccaccacgccttcagcgactac

SEQ ID NO: 4653 - DNA, 325 bp, Artificial
  Mutation in BnaA.FAD2.a introduced by TALE nuclease pair BnFAD2_T01
caggatccatgggtgcaggtggcagaatgcaagtgtctcctgcctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggctgcgtcctaaccggcgtctgggtcatagcccacgagtgcggccaccacgccttcagcgactac

SEQ ID NO: 4654 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctccctcaccctctctcctacttagcctgccaagggtgcgtcctaaccggcgtctgggtcatagcccacgagtgcggccaccacgccttcagcgactac

SEQ ID NO: 4655 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcggcctctctactgggcctgccagggctgcgtcctaaccggcgtctgggtcatagcccacgaatgcggccaccacgccttcagcgactac

SEQ ID NO: 4656 - DNA, 329 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgggcctgccagggctgcgtcctaaccggcgtctgggtcatagcccacgagtgcggccaccacgccttcagcgactac

SEQ ID NO: 4657 - DNA, 341 bp, Artificial
  Mutation in BnaA.FAD2.a introduced by TALE nuclease pair BnFAD2_T01
caggatccatgggtgcaggtgcaagaatgcaagtttctactccctcaaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgtgacatcatcatagcctcctgcttctactacgtcgccaccacttacttccctctcctccctcaccctctctcctacttttactgggccttccagggctacgtcctaaccggcgtctgggtcatagcccacgagtgcggccaccacgccttcagcgactac

SEQ ID NO: 4658 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagcctgaaaccgacaccatcaagcgcgtaccctgcgagacaccgcccttcactgtcggacaactcaagaaagcaatcccaccgcactgtttcaaacgctcgatccctcgctctttctcctacctcatctgggacatcatcatagcctcctgcttctactacgtcgccaccacttacttccctctcctccctccccctctctcctctcctggcctctctactgggcctgccagggctgcgtcctaaccggcgtctgggtcatagcccacgagtgcggccaccacgccttcagcgactac

SEQ ID NO: 4659 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctggcctctctactgggcctgccagggctgcgtcctaacgggcctctgggtcatagcccacgagtgcggccaccacgccttcagcgactac

SEQ ID NO: 4660 - DNA, 356 bp, Artificial
  Mutation in BnaA.FAD2.a introduced by TALE nuclease pair BnFAD2_T01
cagggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacatcgcgcctggcctctctactgggcctgccagggctgcgtcctaaccggcgtctgggtcatagcccacgagtgcggccaccacgccctcagcgactac

SEQ ID NO: 4661 - DNA, 354 bp, Artificial
  Mutation in BnaA.FAD2.a introduced by TALE nuclease pair BnFAD2_T01
caggatccatgggtgcaggtggaagaatgcaagtgtctcctccctccaagaagactgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggtggcctctctactgggcctgtcagggctgcgtcctaaccggcgtctgggtcatagcccacgagtgcggccaccacgccttcagcgactac

SEQ ID NO: 4662 - DNA, 347 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccagggctgcgtcctaaccggcgtctgggtcatagcccacgagtgcggccaccacgccttcagcgactac

SEQ ID NO: 4663 - DNA, 314 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccaacaacatcaagcgcgtaccctgcgagacaccgcccttcactgtcggagaactcaagaaagcaatcccaccgcactgtttcaaacgctcgatccctcgctccttctcctcttcgacatcatcatctcctcctcggctcctccctcaccctctctcctacttctggcctctctactgggcctgccagggctgcgtcctaaccggcgtctgggtcatagcccacgagtgcggccaccacgccttcagcgactac

SEQ ID NO: 4664 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccctggcctctctactgggcctgccagggctgcgtcctaaccggcgtctggggcatagcccacgagtgcggccaccacgccttcagcgactac

SEQ ID NO: 4665 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccatctctcctggcctctctactgggcctgccagggctgcgtcctaaccggcgtctgggtcatagcccacgagtgcggccaccacgccttcagcgactac

SEQ ID NO: 4666 - DNA, 344 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccagggctgcgtcctaaccggcgtctgggtcatagcccacgagtgcggccaccacgccttcagcgactac

SEQ ID NO: 4667 - DNA, 334 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactgcgtcgccaccacttacttccctctcctccctcacccactctctactgggcctgccagggctgcgtcctaaccggcgtctgggtcatagcccacgagtgcggccaccacgccttcagcgactac

SEQ ID NO: 4668 - DNA, 340 bp, Artificial
  Mutation in BnaA.FAD2.a introduced by TALE nuclease pair BnFAD2_T01
caggatccatgggtgcaggtggcagaatgcaagtctctcctccctccagctcccccggaaccaacaccctcaaacgcgtcccctgcgagacaccaccattcactctcggagacctcaagaaagcaatcccaccgcactgtttcaaacgctccatcccacgctccttctcctacctcatctgggacatcatcatagcctcctgcttctactacgtcgccaccacttacttccctctcctccctcaccctctctcctactctactgggcctgccagggctgcgtcctaaccggcgtctgggtcatagcccacgagtgcggccaccacgccttcagcgactac

SEQ ID NO: 4669 - DNA, 350 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaacgggcctctgggtcatagcccacgagtgcggccaccacgccttcagcgactac

SEQ ID NO: 4670 - DNA, 389 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccactgcactgtttcaaacgctcgatccctcgctctttctcctacctcatctgggacatcatcatagcctcctgcttctactacgtcgccaccacttacttccctctcctccctcaccacccacgtataaaccgtcgatgccctgctgaatattgaactgaaccaggcgactggcctctctactgggcctgccaaggctgcgtcctaacgtgcgtctgggtcatagcccacgagtgcggccaccacgccttcagcgactac

SEQ ID NO: 4671 - DNA, 344 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatcctctctactgggcctgccagggctgcgtcctaaccggcgtctgggtcatagcccacgagtgcggccaccacgccttcagcgactac

SEQ ID NO: 4672 - DNA, 347 bp, Artificial
  Mutation in BnaA.FAD2.a introduced by TALE nuclease pair BnFAD2_T01
cagatccatgggtgcaggtggaagaatgcaagtgtctcctccctccacaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 4673 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttggcctctctactgggcctgccaagggtgcgtcctaaccggcgtctgggtcatagcccacgagtgcggccaccacgccatcagcgactac

SEQ ID NO: 4674 - DNA, 337 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgtgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctactgggcctgccaagggtgcgtcctaaccggcgtctgggtcatagcccacgagtgcggccaccacgccttcagcgactac

SEQ ID NO: 4675 - DNA, 349 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgcctgcagcgactac

SEQ ID NO: 4676 - DNA, 358 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctcgcctggcctctctactgggcctgccaagggtgcgtcctaacgggcctctgggtcatagcccacgagtgcggccaccacgccttcagcgactac

SEQ ID NO: 4677 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcggcctctctactgggcctgccagggctgcgtcctaaccggcgtctgggtcatagcccacgagtgcggccaccacgccttcagcgactac

SEQ ID NO: 4678 - DNA, 450 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgaaaacggcttgtcccgcgtcatcggcgggggtcataacgtgactcccttaaggcagtgcatgcatggcgcaatgcactgacgggtgccccgctcaactttggcctctctactgggcctgccagggctgcgtcctaaccggcgtctgggtcatagcccacgagtgcggccaccacgccttcagcgactac

SEQ ID NO: 4679 - DNA, 277 bp, Artificial
  Mutation in BnaA.FAD2.a introduced by TALE nuclease pair BnFAD2_T01
caggatccatgggtgcaggtggcagaatgcaagtgtctcctccctccaagaagcctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacgccttcagcgactac

SEQ ID NO: 4680 - DNA, 341 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctccttttactgggcctgccagggctgcgtcctaaccggcgtctgggtcatagcccacgagtgcggccaccacgccttcagcgactac

SEQ ID NO: 4681 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcccccgcggcccctctactgggcctgccaaggcggcgtcctaacgggcctctgggtcatcgcccacgaatgcggccaccacgccttcagcgactac

SEQ ID NO: 4682 - DNA, 339 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctactgggcctgccagggctgcgtcctaaccggcgtctgggtcatagcccacgagtgcggccaccacgccttcagcgactac

SEQ ID NO: 4683 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttctggcctctctactgggcctgccaagggtgcgtcctaaccggcgtctgggtcatagcccacgagtgcggccaccacgccttcagcgactac

SEQ ID NO: 4684 - DNA, 351 bp, Artificial
  Mutation in BnaA.FAD2.a introduced by TALE nuclease pair BnFAD2_T01
caggatccatgggtgcaggtggaagaatgcaagtctcacctccctccagctcacccggaaccaacatcctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacaacgttgcctctctactgggcctgccagggctgcgtcctaaccggcgtctgggtcatagcccacgagtgcggccaccacgccttcagcgactac

SEQ ID NO: 4685 - DNA, 421 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgccaggcatcaaataaaacgaaaggctcagtctcggtcgttcggctgcggcgagcggtatcagctcactcaaagcctggcctctctactgggcctgccagggctgcgtcctaacgggcctctgggtcatagcccacgagtgcggccaccacgccttcagcgactac

SEQ ID NO: 4686 - DNA, 357 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctccgcccgcctggcctctctactgggcctgccggggctgcgtcctaaccggcgtctgggtcatagcccacgagtgcggccaccacgccttcagcgactac

SEQ ID NO: 4687 - DNA, 334 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccagggctgcgtcctaacgggcctctgggtcatagcccacgagtgcggccaccacgccttcagcgactac

SEQ ID NO: 4688 - DNA, 346 bp, Artificial
  Mutation in BnaA.FAD2.a introduced by TALE nuclease pair BnFAD2_T01
caggatccatgggtgcaggtggaagaatgcaagtgtctcctccctacaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccagggctgcgtcctaaccggcgtctgggtcatagcccacgagtgcggccaccacgccttcagcgactac

SEQ ID NO: 4689 - DNA, 335 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcctctctactgggcctgccagggctgcgtcctaaccggcgcctgggtcatagcccacgagtgcggccaccacgccttcagcgactac

SEQ ID NO: 4690 - DNA, 321 bp, Artificial
  Mutation in BnaA.FAD2.a introduced by TALE nuclease pair BnFAD2_T01
caggatccatgggtgcaggtggaagaatgcaagtgtctcctccccccaaaaagcctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcaagggtgcgtcctaaccggcgtctgggtcatagcccacgagtgcggccaccacgccttcagcgactac

SEQ ID NO: 4691 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctggcctctctactgggcctgccagggctgcgtcctaaccggcgtctgggtcatagcccacgagtgcggccaccacgccttcagcgactac

SEQ ID NO: 4692 - DNA, 345 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggcctgccagggctgcgtcctaaccggcgtctgggtcatagcccacgagtgcggccaccacgccttcagcgactac

SEQ ID NO: 4693 - DNA, 341 bp, Artificial
  Mutation in BnaA.FAD2.a introduced by TALE nuclease pair BnFAD2_T01
caggatccatgggtgcaggtggaagaatgcaagtgtctcctcactccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctactgggcctgccagggctgcgtcctaaccggcgtctgggtcatagcccacgagtgcggccaccacgccttcagcgactac

SEQ ID NO: 4694 - DNA, 341 bp, Artificial
  Mutation in BnaA.FAD2.a introduced by TALE nuclease pair BnFAD2_T01
caggatccatgggtgcaggttgaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctggcctctctactgggcctgccaaggctgcgtcctaacgggcctctgggtcatcgcccacgaatgcggccaccacgccttcagcgactac

SEQ ID NO: 4695 - DNA, 342 bp, Artificial
  Mutation in BnaA.FAD2.a introduced by TALE nuclease pair BnFAD2_T01
caggatccatgggtgcaggtggcagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccagggctgcgtcctaaccggcgtctgggtcatagcccacgagtgcggccaccacgccttcagcgactac

SEQ ID NO: 4696 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 4697 - DNA, 348 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccatcaaacgcgtcccctgcgagacaccaccattcactctcggagacctcaagaaagcaatcccacctcactgcttcaaacgctccatccctcgctctttctcctacctcatctgggacatcatcatagcctcctgcttctactacatcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 4698 - DNA, 268 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcatacgctcgatccctcgctctttctcctacctcatctgggacatcatcatctcctcctcggctcctccctctaccacctctccacagcctacttccctctcccttaccacgccttcagcgactac

SEQ ID NO: 4699 - DNA, 341 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaagcgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttactgggcctgccagggctgcgtcctaaccggcgtctgggtcatagcccacgagtgcggccaccacgccttcagcgactac

SEQ ID NO: 4700 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatcgcctcctgcttctactacgtcgccaccacttacttccctctcctcccccaccctctccctaaccccgcctggccctctactgggcctgccaaggctgcgtcctaacgggcctctgggtcatcgcccacgaatgcggccaccacgccttcagcgactac

SEQ ID NO: 4701 - DNA, 338 bp, Artificial
  Mutation in BnaA.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattactgggcctgccagggctgcgtcctaaccggcgtctgggtcatagcccacgagtgcggccaccacgccttcagcgactac

SEQ ID NO: 4702 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactaaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 4703 - DNA, 386 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgaccgccacctgctggggggtcaagccgtgggcctggcacagtctctactgggcctgccagggctgcgtcctaaccggcgtctgggtcatagcccacgagtgcggccaccacgccttcagcgactac

SEQ ID NO: 4704 - DNA, 348 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcggcctaaccggcgtctgggtcatagcccacgagtgcggccaccacgccttcagcgactac

SEQ ID NO: 4705 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctccactgggcctgccagggctgcgtcctaaccggcgtctgggtcatagcccacgagtgcggccaccacgccttcagcgactac

SEQ ID NO: 4706 - DNA, 346 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccagggctgcgtcctaaccggcgtctgggtcatagcccacgagtgcggccaccacgccttcagcgactac

SEQ ID NO: 4707 - DNA, 339 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctactgggcctgccagggctgcgtcctaaccggcctctgggtcatagcccacgagtgcggccaccacgccttcagcgactac

SEQ ID NO: 4708 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccagggctgcgtcctaaccggcgtctgggtcatagcccacgagtgcggccaccacgcctgcagcgactac

SEQ ID NO: 4709 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctggcctctctactgggcctgccagggctgcgtcctaaccggcgtctgggtcatagcccacgagtgcggccaccacgccttcagcgactac

SEQ ID NO: 4710 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccgcttacttccctctcctccctcaccctctctcctacttctggcctctctactgggcctgccagggctgcggcctaaccggcgtctgggtcatagcccacgagtgcggccaccacgccttcagcgactac

SEQ ID NO: 4711 - DNA, 429 bp, Artificial
  Mutation in BnaA.FAD2.a introduced by TALE nuclease pair BnFAD2_T01
caggatccatgggtgcaggtggcagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttccttccctctcctccctcaccctctctcctccttcgggcgtcctgcccgccaccctccgggccgttgcttcactctatcgtggctggcgatggccaccacctgctccggggtcatggcctctctactgggcctgccagggctgcgtcctaaccggcgtctgggtcatagcccacgagtgcggccaccacgccttcagcgactac

SEQ ID NO: 4712 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctaccacctctccacagcctacttccctctcctccctcaccctctctcctacttggcctctctactgggcctgccagggctgcgtcctaaccggcgtctgggtcatagcccacgagtgcggccaccacgccttcagcgactac

SEQ ID NO: 4713 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacatggcctctctactgggcctgccaagggtgcgtcctaacgggcctctgggtcatagcccacgagtgcggccaccacgccttcagcgactac

SEQ ID NO: 4714 - DNA, 346 bp, Artificial
  Mutation in BnaA.FAD2.a introduced by TALE nuclease pair BnFAD2_T01
caggatccatgggtgcaggtggcagaatgcaagtgtctcctcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgagtgcggccaccacgccttcagcgactac

SEQ ID NO: 4715 - DNA, 398 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagacctcaagaaagcaatcccacctcactgcttcaaacgctccatccctcgctccttctcctacctcctcttcgacatcctcgtctcctcctccctctaccacctctccacagcctacttccctctcctccctcaccctctctgccaacttctcaagattgcaaaacgtggcggcgtgaccgcagtggaggcagtgcatgcgcctctctactgggcctgccaagggtgcgtcctaaccggcgtctgggtcatagcccacgagtgcggccaccacgccttcagcgactac

SEQ ID NO: 4716 - DNA, 335 bp, Artificial
  Mutation in BnaA.FAD2.a introduced by TALE nuclease pair BnFAD2_T01
caggatccatgggtgcaggtggcagaatgcaagtgtctcctccctcccagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcctctctactgggccggccggggcggcggcctaaccggcgtctgggtcatagcccacgaggtcggccaccacgccttcagcgactac

SEQ ID NO: 4717 - DNA, 331 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgggcctgccagggctgcgtcctaaccggcgtctgggtcatagcccacgagtgcggccaccacgccttcagcgactac

SEQ ID NO: 4718 - DNA, 350 bp, Artificial
  Mutation in BnaA.FAD2.a introduced by TALE nuclease pair BnFAD2_T01
caggatccatgggtgcagatggaagaatgcaagtgtcaactccctccaaaaagtctgaaaccgacaacatcaagcgcgtaccctgcgagacaccgcccttcactgtcggagaactcaagaaagtaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 4719 - DNA, 348 bp, Artificial
  Mutation in BnaA.FAD2.a introduced by TALE nuclease pair BnFAD2_T01
caggatccatgggtgcaggtggcagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 4720 - DNA, 341 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttactgggccagccagggctacgtcctgaccggcgtctgggtcatagcccaccagtgcggccaccatgcctgcagcgactac

SEQ ID NO: 4721 - DNA, 345 bp, Artificial
  Mutation in BnaA.FAD2.a introduced by TALE nuclease pair BnFAD2_T01
caggatccatgggtgcaggtggaataatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaaggctgcgtcctaacgggcctctgggtcatcgcccacgaatgcggccaccacgccttcagcgactac

SEQ ID NO: 4722 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaaccaatcccaccgcactgtttcaaacgctcgatccctcgctctttctcctacctcatctgggacatcatcatagcctcctgcttctactacgtcgccaccacttacttccctctcctcccaccctctctcctactcgcctctctactgggcctgccagggctgcgtcctaaccggcgtctgggtcatagcccacgagtgcggccaccacgcctgcagcgactac

SEQ ID NO: 4723 - DNA, 348 bp, Artificial
  Mutation in BnaA.FAD2.a introduced by TALE nuclease pair BnFAD2_T01
caggatccatgggtgcaggtggaagaatgcaagtgtctcctcactccaaaaagtctgaaacctacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcggcctaaccggcgtctggggcatagcccacgagtgcggccaccacgccttcagcgactac

SEQ ID NO: 4724 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccagggctgcgtcctaacgggcctctgggtcatcgcccacgaatgcggccaccacgccttcagcgactac

SEQ ID NO: 4725 - DNA, 348 bp, Artificial
  Mutation in BnaA.FAD2.a introduced by TALE nuclease pair BnFAD2_T01
caggatccatgggtgcaggtggcagaatgcaagtgtatactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacttggcctctctactgggcctgccaagggtgcgtcctaacgggcctctgggtcatcgcccacgaatgcggccaccacgcctgcagcgactac

SEQ ID NO: 4726 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgcctgcagcgactac

SEQ ID NO: 4727 - DNA, 348 bp, Artificial
  Mutation in BnaA.FAD2.a introduced by TALE nuclease pair BnFAD2_T01
caggatccatggatgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaaggctgcgtcctaacgggcctctgggtcatcgcccacgaatgcggccaccacgccttcagcgactac

SEQ ID NO: 4728 - DNA, 349 bp, Artificial
  Mutation in BnaA.FAD2.a introduced by TALE nuclease pair BnFAD2_T01
caggtccatgggtgcaggtggaagaatgcaagtctctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 4729 - DNA, 357 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgcccgcctggcctctctactgggcctgccagggctgcgtcctaaccggcgtctgggtcatagcccacgagtgcggccaccacgccttcagcgactac

SEQ ID NO: 4730 - DNA, 345 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccagggctgcgtcctaaccggcgtctgggtcatagcccacgagtgtggccaccacgccttcagcgactac

SEQ ID NO: 4731 - DNA, 423 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtccccaccacttacttccctctcctccctcaccctctctcctcctgtgccaggcccacggcttgaccccggggcaggtgggggccatcgccagccacgatggcggcaacagccgctggactggcctctctactgggcctgccagggctgcgtcctaaccggcgtctgggtcatagcccacgagtgcggccaccacgccttcagcgactac

SEQ ID NO: 4732 - DNA, 349 bp, Artificial
  Mutation in BnaA.FAD2.a introduced by TALE nuclease pair BnFAD2_T01
caggatccatgggtgcaggtggaagaatgcaagtctatccttcctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctgcctctctactgggcctgccagggctgcgtcctaaccggcgtctgggtcatagcccacgagtgcggccaccacgccttcagcgactac

SEQ ID NO: 4733 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcatctgggacatcatcatagcctcctgcttctactacgtcgccaccacttacttccctctcctccctcaccctctctcctatcctctctactgggcctgccagggctgcgtcctaaccggcgtctgggtcatagcccacgagtgcggccaccacgccttcagcgactac

SEQ ID NO: 4734 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttccctctctactgggcctgccaagggtgcgtcctaaccggcgtctgggtcatagcccacgagtgcggccaccacgccttcagcgactac

SEQ ID NO: 4735 - DNA, 357 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcgcgcctggcctctctactgggcctgccagggctgcgtcctaaccggcgtctgggtcatagcccacgagtgcggccaccacgccttcagcgactac

SEQ ID NO: 4736 - DNA, 342 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcacccgctcgcctactctctactgggcctgccagggctgcgtcctaaccggcgtctgggtcatagcccacgagtgcggccaccacgcctgcagcgactac

SEQ ID NO: 4737 - DNA, 334 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcacccactctctactgggcctgccagggcggcgtcctaaccggcgtctgggtcatagcccacgagtgcggccaccacgcctgcagcgactac

SEQ ID NO: 4738 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttccttccctctcctccctcaccctctctcctccttcgcccctggcctctctactgggcctgccaaggctgcgtcctaacgggcctctgggtcatagcccacgagtgcggccaccacgccttcagcgactac

SEQ ID NO: 4739 - DNA, 331 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccctctctccgggcctgccagggctgcgtcctaaccggcgtctgggtcatagcccacgagtgcggccaccacgccttcagcgactac

SEQ ID NO: 4740 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagcctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 4741 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctccatccctcgctccttctcctacctcctcttcgacatcctcgtctcctcctccctctaccacctctccacagcctacttccctctcctcccccaccctctctcctacttcgcggcctctctactgggcctgccagggctgcgtcctaaccggcgtctgggtcatcgcccacgaatgcggccaccacgccttcagcgactac

SEQ ID NO: 4742 - DNA, 354 bp, Artificial
  Mutation in BnaA.FAD2.a introduced by TALE nuclease pair BnFAD2_T01
caggatccatgggtgcaggtggcagaatgcaagtgtcacctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccttggcctctctactgggcctgccatggctgcgtcctaaccggcgtctgggtcatagcccacgagtgcggccaccacgccttcagcgactac

SEQ ID NO: 4743 - DNA, 350 bp, Artificial
  Mutation in BnaA.FAD2.a introduced by TALE nuclease pair BnFAD2_T01
caggatccatgggtgcaggtggcagaatgcaagtgtcaactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcttctggcctctctactgggcctgccagggctgcgtcctaaccggcgtcggggtcatagcccacgagtgcggccaccacgccttcagcgactac

SEQ ID NO: 4744 - DNA, 331 bp, Artificial
  Mutation in BnaA.FAD2.a introduced by TALE nuclease pair BnFAD2_T01
caggatccagggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcatagcccacgagtgcggccaccacgccttcagcgactac

SEQ ID NO: 4745 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcagagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 4746 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagcctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 4747 - DNA, 386 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggccaccacctgctggggggtcaagccgtgggcctggcacagtctctactgggcctgccagggctgcgtcctaacgggcctctgggtcatcgcccacgaatgcggccaccacgccttcagcgactac

SEQ ID NO: 4748 - DNA, 342 bp, Artificial
  Mutation in BnaA.FAD2.a introduced by TALE nuclease pair BnFAD2_T01
caggatccatgggtgcaggtggaagaatgcaagtctctactccctccagctcccccggaaccaacaccctcaaacgcgtcccctgcgagacaccaccattcactctcggagacctcaagaaagcaatcccacctcactgcttcaaacgctccatcccacgctccttctcctcttcgacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 4749 - DNA, 345 bp, Artificial
  Mutation in BnaA.FAD2.a introduced by TALE nuclease pair BnFAD2_T01
caggatccatgggtgcaggtggaagaatgcaagtgtcacctccctcgaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacttcgcccccacttacttccctctcctccctcaccctctttcctaccccctctactgggactgctagagctgcgtccgaaccggcgtctgggtcatagcctgcgagtgctgccacctcgcgctcagcgactacc

SEQ ID NO: 4750 - DNA, 348 bp, Artificial
  Mutation in BnaA.FAD2.a introduced by TALE nuclease pair BnFAD2_T01
caggatccatgggtgcaggtggaagaatgcaagtgtcacctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacgtggcctctctactgggcctgccaatggtgcgtcctaaccggcgtctgggtcatagcccacgagtgcggccaccacgccttcagcgactac

SEQ ID NO: 4751 - DNA, 338 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattactgggcctgccagggctgcgtcctaaccggcgtctgggtcatagcccacgagtgcggccaccacgccttcagcgactac

SEQ ID NO: 4752 - DNA, 332 bp, Artificial
  Mutation in BnaA.FAD2.a introduced by TALE nuclease pair BnFAD2_T01
caggatccatgggtgcaggtggaagaatgcaagtgtcacctccctccaaaaagtctgaaaccgacaacctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcatagcccacgagtgcggccaccacgccttcagcgactac

SEQ ID NO: 4753 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccaagggtgcgtcctaacgggcctctgggtcatcgcccacgaatgcggccaccacgccttcagcgactac

SEQ ID NO: 4754 - DNA, 325 bp, Artificial
  Mutation in BnaA.FAD2.a introduced by TALE nuclease pair BnFAD2_T01
caggatccatgggtgcaggtggaagaatgcaagtgtctcctccctccaaaaagactgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggctgcgtcctaaccggcgtctgggtcatagcccacgagtgcggccaccacgccttcagcgactac

SEQ ID NO: 4755 - DNA, 347 bp, Artificial
  Mutation in BnaA.FAD2.a introduced by TALE nuclease pair BnFAD2_T01
caggatccatgggtgcaggtggaagaatgcaagtctctcctccctccaaaaagcctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgccttgcctctctactgggcctgccaaggcggcgtcctaacctgcgtctgggtcatagcccacgagtgcggccaccgcgccttcagcgactac

SEQ ID NO: 4756 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgctggcccctctactgggcctgccaaggctgcgtcctaacgggcctctgggtcatagcccacgagtgcggccaccacgccttcagcgactac

SEQ ID NO: 4757 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagcctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacccctctactgggcctgccaaggctgcgtcctaacgggcctctgggtcatcgcccacgaatgcggccaccacgccttcagcgactac

SEQ ID NO: 4758 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccagggctgcgtcctaacgggcctctgggtcatcgcccacgaatgcggccaccacgccttcagcgactac

SEQ ID NO: 4759 - DNA, 342 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcgcctggcctctctactgggcctgccaagggtgcgtcctaacgggcctctgggtcatcgcccacgaatgcggccaccacgccttcagcgactac

SEQ ID NO: 4760 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccaagggtacgtcctaaccggcgtctgggtcatagcccacgagtgcggccaccacgccttcagcgactac

SEQ ID NO: 4761 - DNA, 385 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccccgtgggcctggcacagcaccggcaacagccgctggaccgtctccagcgcctgcctggcctctctactgggcctgccaagggtgcgtcctaaccggcgtctgggtcatagcccacgagtgcggccaccacgccttcagcgactac

SEQ ID NO: 4762 - DNA, 346 bp, Artificial
  Mutation in BnaA.FAD2.a introduced by TALE nuclease pair BnFAD2_T01
caggatccatgggtgcaggtggaagaatgcaagtgtctcctcccttcaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccagggctgcgtcctaaccggcgtctgggtcatagcccacgagtgcggccaccacgccttcagcgactac

SEQ ID NO: 4763 - DNA, 348 bp, Artificial
  Mutation in BnaA.FAD2.a introduced by TALE nuclease pair BnFAD2_T01
caggatccattggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctggcctctctactgggcctgccagggctgcgtcctaacgggcctctgggtcatcgcccacgaattcggccaccacgccttcagcgactac

SEQ ID NO: 4764 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagactgaaaccgacaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttcttctacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 4765 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccatcaccctctctcctaggcctctctactgggcctgccagggctgcgtcctaaccggcgtctgggtcatagcccacgagtgcggccaccacgccttcagcgactac

SEQ ID NO: 4766 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggcctctctactgggcctgccaagggtgcgtcctaacgggcctctgggtcatagcccacgagtgcggccaccacgccttcagcgactac

SEQ ID NO: 4767 - DNA, 417 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgtcaggacatgatcgcagcgttgccagagcgagattctccgcgctgtagaagtcaccattgttgtgctggcctctctactgggcctgccagggctgcgtcctaaccggcgtctgggtcatagcccacgagtgcggccaccacgccttcagcgactac

SEQ ID NO: 4768 - DNA, 345 bp, Artificial
  Mutation in BnaA.FAD2.a introduced by TALE nuclease pair BnFAD2_T01
caggatccatgggtgcaggtggaagaatgcaagtgtcccctccctccaaaaagactgaaaccgacaacatcaagcgcgtaccctgcgagacaccgcccttcactgtcggagaactcaagaaagcaatcccactgcactgtttcaaacgctcgatccctcgctctttctcctacctcatctgggacatcatcatagcctcctgcttctactacgtcgccaccacttacttccctctcctccctcaccctctctccgaagcctctctactgggcctgccagggctgcgtcctaaccggcgtctgggtcatagcccacgagtgcggccaccacgcctgcagcgactac

SEQ ID NO: 4769 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgcccctggcctctctactgggcctgccaagggtgcgtcctaaccggcgtctgggtcatagcccacgagtgcggccaccacgccttcagcgactac

SEQ ID NO: 4770 - DNA, 342 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccagggctgcgtcctaaccggcgtctgggtcatagcccacgagtgcggccaccacgccttcagcgactac

SEQ ID NO: 4771 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctttggcctctctacggggcctgccaagggtgcgtcctaaccggcctctgggtcataggccacgagtgcggccaccacgccttcagcgactac

SEQ ID NO: 4772 - DNA, 325 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcgtctgggacatcatcatagcctcctgcttctactacgtcgccaccacttacttccctctcctccctcaccctctctcctacttggctgcgtcctaaccggcgtctgggtcatagcccacgagtgcggccaccacgccttcagcgactac

SEQ ID NO: 4773 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttaccttggcccctctactgggcctgccaaggctgcgtcctaacgggcctctgggtcatcgcccacgaatgcggccaccacgccttcagcgactac

SEQ ID NO: 4774 - DNA, 332 bp, Artificial
  Mutation in BnaA.FAD2.a introduced by TALE nuclease pair BnFAD2_T01
caggatccatgggtgcaggtggaagaatgcaagtgtatcctccctccaaaaagtctgaaaccgacaacatcaagcgcgtaccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctactgggcctgccaagggggcgtcctaaccggcgtctgggtcatagcccacgagtgcggccaccacgccttgagcgactac

SEQ ID NO: 4775 - DNA, 378 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcccccctcaccctctctcctgcttcgcccccagcccctgcttgccgccaccgcggctggcgatggccaccacctgctccggggtcaagccgtgagggctgggtcatagcccacgagtgcggccaccacgccttcagcgactac

SEQ ID NO: 4776 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacataaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgcctgcagcgactac

SEQ ID NO: 4777 - DNA, 347 bp, Artificial
  Mutation in BnaA.FAD2.a introduced by TALE nuclease pair BnFAD2_T01
caggatccatgggtgcaggtggaagaatgcaagtgtctcctgcctccagctccaccgaaaccaaaaccctcaaacgcgtcccctgcgagacaccgcccttcactgtcggagaactcaagaaagcagtcccaccgcactgtttcaaacgctcgatccctcgctctttctcctacctcatctgggacatcatcatagcctcctgcttctactacgtcgccaccactttcttccctctcctccctcaccctctctcctactggcctctctactgggcctgccagggccgcgtcctaagcggcgtctgggtcatagccgacgagtgcggccaccacgcctgcagcgactac

SEQ ID NO: 4778 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagactgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctaaccggcgtctgggtcatagcccacgagtgcggccaccacgccttcagcgactac

SEQ ID NO: 4779 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcttctggcctctctactgggcctgccagggctgcgtcctaaccggcgtctgggtcatagcccacgagtgcggccaccacgccttcagcgactac

SEQ ID NO: 4780 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgatacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcgcctctctactgggcctgccagggctgcgtcctaaccggcgtctgggtcatagcccacgagtgcggccaccacgccttcagcgactac

SEQ ID NO: 4781 - DNA, 344 bp, Artificial
  Mutation in BnaA.FAD2.a introduced by TALE nuclease pair BnFAD2_T01
caggatccatgggtgcaggtggaagaatgcaggtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatcctctctactgggcctgccagggctgcgtcctaaccggcgtctgggtcatagcccacgagtgcggccaccacgtcttcagcgactac

SEQ ID NO: 4782 - DNA, 430 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtttgccggtgctgtgccaggcgctcggtcgttcggctgcggcgagcggtatcagctcactcaaaggcggtaatacggttatcctggcctctctactgggcctgccagggctgcgtcctaaccggcgtctgggtcatagcccacgagtgcggccaccacgcctcagcgactac

SEQ ID NO: 4783 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccactaacttccctctcctccctcaccctctctcctatggcctctctactgggtctgccagggctgcgtcctaaccggcgtctgggtcatagcccacgagtgcggccaccacgccttcagcgactac

SEQ ID NO: 4784 - DNA, 341 bp, Artificial
  Mutation in BnaA.FAD2.a introduced by TALE nuclease pair BnFAD2_T01
caggatccatgggtgcaggtggaagaatgcaagtgtctcctccctccaagaagacggaaaccgacaccatcaagcgcgtaaactgcgagacaccgcccttcactgtcggagaactcaagaaagcaatcccaccgcactgaagcaaacgctcgatccctcgctctttctcctacctcatctgggacatcatcatagcctcctgcttctactacgtcgccaccacttacttccctctcctccctcaccctctctcctacctctactgggcctgccagggctgcgtcctaaccggcgtctgggtcatagcccacgagtgcggccaccacgccttcagcgactac

SEQ ID NO: 4785 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcgtctactacgtcgccaccacttacttccctctcctccctccccctctctcccacttggcctctctactgggcctgccagggctgcgtcctaaccggcgtctgggtcatagcccacgagtgcggccaccacgccttcagcgactac

SEQ ID NO: 4786 - DNA, 352 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccgccctggcctctctactgggcctgccagggctgcgtcctaaccggcgtctgggtcatagcccacgagtgcggccaccacgccttcagcgactac

SEQ ID NO: 4787 - DNA, 348 bp, Artificial
  Mutation in BnaA.FAD2.a introduced by TALE nuclease pair BnFAD2_T01
caggatccatgggtgcaggtggaataatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 4788 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctactcggcctgccagggctgcgtcctaaccggcgtctgggtcatagcgcacgagtgcggccaccacgccttcagcgactac

SEQ ID NO: 4789 - DNA, 333 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctggacatcatcatagcctcctgcttctactacgtcgccaccacttacttccctctcctccctcaccctctctctactgggcctgccagggctgcgtcctaaccggcgtctgggtcatagcccacgagtgcggccaccacgccttcagcgactac

SEQ ID NO: 4790 - DNA, 349 bp, Artificial
  Mutation in BnaA.FAD2.a introduced by TALE nuclease pair BnFAD2_T01
caggatccatgggtgcaggtggaagaatgcaagtgtctcctcactccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggggcgtcctaaccggcgtctgggtcatagcccacgagtgcggccaccacgccttcagcgactac

SEQ ID NO: 4791 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctccctctgccctctctactgggcctcccagggctgcgtcctaaccggcgtctggttcttagcccccaagtgcgtccaccgcgcctcctgggactac

SEQ ID NO: 4792 - DNA, 311 bp, Artificial
  Mutation in BnaA.FAD2.a introduced by TALE nuclease pair BnFAD2_T01
caggatccatgggtgcagtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctgtgcgtcctaaccggcgtctgggtcatagcccacgagtgcggccaccacgccttcagcgactac

SEQ ID NO: 4793 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcggcctaaccggcgtctgggtcatagcccacgagtgcggccaccacgccttcagcgactac

SEQ ID NO: 4794 - DNA, 343 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccagggctgcgtcctaaccggcgtctgggtcatagcccacgagtgcggccaccacgccttcagcgactac

SEQ ID NO: 4795 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccgctggcctctctactgggcctgccaaggctgcgtcctaacgggcctctgggtcatcgcccacgaatgcggccaccacgccttcagcgactac

SEQ ID NO: 4796 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaaacgcgtcccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 4797 - DNA, 343 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccatggctgcgtcctaaccggcgtctgggtcatagcccacgagtgcggccaccacgccttcagcgactac

SEQ ID NO: 4798 - DNA, 358 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcgggtctggcctctctactaggcctgccagggctgcgtcctaaccggcgtctgggtcatagcccacgagtgcggccaccacgccttcagcgactac

SEQ ID NO: 4799 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctccctcaccctctctcctacttctggcctctctactgggcctgccagggctgcgtcctaaccggcgtctgggtcatagcccacgagtgcggccaccacgccttcagcgactac

SEQ ID NO: 4800 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccagggctgcgtcctaaccggcgtctgggtcatagcccacgagtgcggccaccacgccttcagcgactac

SEQ ID NO: 4801 - DNA, 346 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcacctacggcctctctactgggcctgccagggctgcgtcctaaccggcgtctgggtcatagcacacgagtgcggccaccacgccttcagcgactac

SEQ ID NO: 4802 - DNA, 342 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcgcctagcctctctactgggcctgccaagggtgcgtcctaaccggcgtctgggtcatagcccacgagtgcggccaccacgccttcagcgactac

SEQ ID NO: 4803 - DNA, 339 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctctcctacttactgggcctgccagggctgcgtcctaaccggcgtctgggtcatagcccacgagtgcggccaccacgcctgcagcgactac

SEQ ID NO: 4804 - DNA, 351 bp, Artificial
  Mutation in BnaA.FAD2.a introduced by TALE nuclease pair BnFAD2_T01
caggatccatgggtgcaggtggaagaatgcaagtctctcctccctccagctccccggaaaccacccccttcaaacccttccccgccgagaacccccctttcactctcggagacctcaagaaagcattcccaccgcactgtttcaaacgctcgatccctcgctctttctcctacctcatctgggacaccatcatagcctcctgcttctactacgtcgccaccacttacttccctctcctccctcaccctctctcctacttcctggcctctctactgggcctgccagggctgcgtcctaaccggcgtctgggtcatagcccacgagtgcggccaccacgccttcagcgactac

SEQ ID NO: 4805 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctagccggcgtctgggtcatagcccacgagtgcggccaccacgccttcagcgactac

SEQ ID NO: 4806 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctctctctttctcctacctcatctgggacatcatcatagcctcctgctcctactacgtcgccaccacttacttccctctcctccctcaccctctctcccacttcgcctctctactgggcctgccagggctgcgtcctaaccggcgtctgggtcatagcccacgagtgcggccaccacgccttcagcgactac

SEQ ID NO: 4807 - DNA, 349 bp, Artificial
  Mutation in BnaA.FAD2.a introduced by TALE nuclease pair BnFAD2_T01
caggatccatgggtgcaggtggaagaatgcaagtctctcctccctccagctcccccggaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctctctactgggcctgccagggctgcgtcctaaccggcgtctgggtcatagcccacgagtgcggccaccacgccttcagcgactac

SEQ ID NO: 4808 - DNA, 381 bp, Artificial
  Mutation in BnaA.FAD2.a introduced by TALE nuclease pair BnFAD2_T01
caggatccatgggtgcaggtggcagaatgcaagtgtctacaccctccaagaagcctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccccctcccttccctcgctcgccgcagccgaacgaccgagcgcagcgtggcccctctactgggcctgccaaggctgcgtcctaacgggcctctgggtcatagcccacgagtgcggccaccacgcctgcagcgactac

SEQ ID NO: 4809 - DNA, 340 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcattgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccagggctgcgtcctaaccggcgtctgggtcatagcccacgagtgcggccaccacgccttcagcgactac

SEQ ID NO: 4810 - DNA, 385 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccccttacttccctctcctccccgtgggcctggcacggccccggcaacagccgctggaccgtctccagcgcctgcctggcctctctactgggcctgccaagggtgcgtcctaaccggcgtctgggtcatagcccacgagtgcggccaccacgccttcagcgactac

SEQ ID NO: 4811 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 4812 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccagggctgcgtcctaaccggcgtctgggtcatagcccacgaatgcggccaccacgccttcagcgactac

SEQ ID NO: 4813 - DNA, 352 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggcctctctactgggcctgccagggctgcgtcctaaccggcgtctgggtcatagcccacgagtgcggccaccacgccttcagcgactac

SEQ ID NO: 4814 - DNA, 339 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctctctactgggcctgccaagggtgcgtcctaaccggcgtctgggtcatagcccacgagtgcggccaccacgccttccagcgactac

SEQ ID NO: 4815 - DNA, 334 bp, Artificial
  Mutation in BnaA.FAD2.a introduced by TALE nuclease pair BnFAD2_T01
caggatccatgggtgcaggtggaagaatgcaagtgtctaccccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccagggctgcgtcctaaccggcgtctgggtcatagcccacgagtgcggccaccacgccttcagcgactac

SEQ ID NO: 4816 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctggcccctctactgggcctgccaaggctgcgtcctaacgggcctctgggtcatcgcccacgaatgcggccaccacgccttcagcgactac

SEQ ID NO: 4817 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggccttccaagggtgcgtcctaaccggcgtctgggtcatagcccacgagtgcggccaccacgccttcagcgactac

SEQ ID NO: 4818 - DNA, 385 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccccgtgggcctggcacaccaccggcaacagccgctggaccgtctccagcgcctgcctggcctctctactgggcctgccaagggtgcgtcctaaccggcgtctgggtcatagcccacgagtgcggccaccacgccttcagcgactac

SEQ ID NO: 4819 - DNA, 348 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctggggcatcatcatagcctcctgcttctactacgtcgccaccacttacttccctctcctccctcaccctctctcctgcctggcctctctactgggcctgccagggctgcgtcctaaccggcgtctgggtcatagcccacgagtgcggccaccacgccttcagcgactac

SEQ ID NO: 4820 - DNA, 341 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacctacttccctctcctccctcaccctctctcccccctctactgggcctgccagggctgcgtcctaaccggcgtctgggtcatagcccacgagtgcggccaccacgccttcagcgactac

SEQ ID NO: 4821 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggcttcgtcctaaccggcgtctgggtcatagcccacgagtgcggccaccacgccttcagcgactac

SEQ ID NO: 4822 - DNA, 349 bp, Artificial
  Mutation in BnaA.FAD2.a introduced by TALE nuclease pair BnFAD2_T01
caggatccatgggagcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 4823 - DNA, 340 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccactctactgggcctgccagggctgcgtcctaaccggcgtctgggtcatagcccacgagtgcggccaccacgccttcagcgactac

SEQ ID NO: 4824 - DNA, 354 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccttggcctctctactgggcctgccagggctgcgtcctaaccggcgtccgggtcatagcccacgagtgcggccaacacgccttcagcgactac

SEQ ID NO: 4825 - DNA, 393 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgaacggtgcaggcgctgttgccggtgctgtgccaggcccacggcttgacccctggcctctctactgggcctgccagggctgcgtcctaaccggcgtctgggtcatagcccacgagtgcggccaccacgccttcagcgactac

SEQ ID NO: 4826 - DNA, 312 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctccttctcctacctcatctgggacatcatcatagcctcctgcttctactacgtcgccaccacttacttccctctcctccctcaccctgtgcgtcctaaccggcgtctgggtcatagcccacgagtgcggccaccacgccttcagcgactac

SEQ ID NO: 4827 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttatggcctctctactgggcctgccagggctgcgtcctaaccggcgtctgggtcatagcccacgagtgcggccaccacgccttcagcgactac

SEQ ID NO: 4828 - DNA, 343 bp, Artificial
  Mutation in BnaA.FAD2.a introduced by TALE nuclease pair BnFAD2_T01
caggatccatgggtgcaggtggaagaatgcaagtgtctcctcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccagggctgcgtcctaaccggcgtctgggtcatagcccacgagtgcggccaccacgccttcagcgactac

SEQ ID NO: 4829 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacttggcctctctactgggcctgccagggctgcgtcctaacgggcctctgggtcatagcccacgagtgcggccaccacgccttcagcgactac

SEQ ID NO: 4830 - DNA, 341 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctactgggcctgccagggctgcgtcctaaccggcgtctgggtcatcgcccacgaatgcggccaccacgccttcagcgactac

SEQ ID NO: 4831 - DNA, 358 bp, Artificial
  Mutation in BnaA.FAD2.a introduced by TALE nuclease pair BnFAD2_T01
caggatccatgggtgcaggtggaagaatgcaagtctctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactccgtcgccaccacttacttccctctcctccctcaccctctctcctacttcgccgggtctggcctctctactaggcctgccagggctgcgtcctaaccggcgtctgggtcatagcccacgagtgcggccaccacgccttcagcgactac

SEQ ID NO: 4832 - DNA, 417 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctccttctcctacctcatctgggacatcatcatagcctcctgcttctactacgtcgccaccacttacttccctctcctccctcaccctctctcctcctccgccaggccatcatcgcagcgttgccagcgcgcgattctccgcgctgtagccgtcaccattgttgtgctggcctctctactgggcctgccagggctgcgtcctaaccggcgtctgggtcatagcccacgagtgcggccaccacgccttcagcgactac

SEQ ID NO: 4833 - DNA, 253 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctcttcgacatcctcgtctcctcctccctctaccacctctccacagcctacttccctctcccttaccacgccttcagcgactac

SEQ ID NO: 4834 - DNA, 337 bp, Artificial
  Mutation in BnaA.FAD2.a introduced by TALE nuclease pair BnFAD2_T01
caggatccatgggtgcaggtggaagaatgcaagtgtctactccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctactgggcctgccagggctgcgtcctaaccggcgtctgggtcatagcccacgagtgcggccaccacgccttcagcgactac

SEQ ID NO: 4835 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccatcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccagggctgcgtcctaaccggcgtctgggtcatagcccacgagtgcggccaccacgccttcagcgactac

SEQ ID NO: 4836 - DNA, 350 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcctcgtctcctcctccctctaccacctctccacagcctacttccctctcctcccccaccctctcccttgcctctggcccctctactgggcctgccaaggctgcgtcctaacgggcctctgggtcatcgcccacgaatgcggccaccacgccttcagcgactac

SEQ ID NO: 4837 - DNA, 338 bp, Artificial
  Mutation in BnaA.FAD2.a introduced by TALE nuclease pair BnFAD2_T01
caggatccatgggtgcaggtggaagaatgcaagtgtctcctccctccaaaaagcctgaaaccgacaacctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactactgggcctgccaagggtgcgtcctaaccggcgtctgggtcatagcccacgagtgcggccaccacgccttcagcgactac

SEQ ID NO: 4838 - DNA, 348 bp, Artificial
  Mutation in BnaA.FAD2.a introduced by TALE nuclease pair BnFAD2_T01
caggatccatgggtgcaggtggaagaatgcaagtgtctacccactccaaaaagactgaaaccgacaacatcaagcgcgtaccctgcgagacaccgcccttcactgtcggagaactcaagaaagcaatcccaccgcactgtttcaaacgctcgatccctcgctatttctcctacctcatctgggacatcatcatagcctcctgcttctactacgtcgccaccacttacttccctctcctccctcaccctctctcctacttggcctctctactgggcctgccaagggtgcgtcctatccgtcgtctgggtcatagcccaccagtgcgtccaccacgccttttgcgactac

SEQ ID NO: 4839 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctggcctctctactgggcctgccagggctgcgtcctaaccggcgtctgggtcatagcccacgagtgcggccaccacgccttcagcgactac

SEQ ID NO: 4840 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagcctgaaaccgacaccctcaagcgcgtaccctgcgagacaccgcccttcactgtcggagaactcaagaaagcaatcccaccgcactgtttcaaacgctcgatccctcgctctttctcctacctcctctgggacatcatcatctcctcctgcctctactacctctccaccccctacttccctctcctccctcaccctctcccccaggcctctctactgggcctgccaaggctgcgtcctaaccggcgtctgggtcatagcccacgagtgcggccaccacgccttcagcgactac

SEQ ID NO: 4841 - DNA, 393 bp, Artificial
  Mutation in BnaA.FAD2.a introduced by TALE nuclease pair BnFAD2_T01
caggatccatgggtgcaggtggaagaatgcaagtgtcacccccctccaagaagtctgaaaccgacaccataaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctaacggtgcgggcgctgttgccggtgctgtgccaggcccacggctggacccctgacctctctactgggcctgccagggctgcggcctaaccggcgtctgggtcatagcccacgagtgcggccaccacgccttcagcgactac

SEQ ID NO: 4842 - DNA, 349 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaacccccaaacgcgtcccctgcgagacaccacccttcactgtcggagaactcaagaaagcaatcccaccgcactgtttcaaacgctcgctccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgcctgcagcgactac

SEQ ID NO: 4843 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctgcctctctactgggcctgccaagggtgcgtcctaaccggcgtctgggtcatagcccacgagtgcggccaccacgccttcagcgactac

SEQ ID NO: 4844 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcctctctactgggcctgccagggctgcgtcctaacgggcctctgggtcatagcccacgagtgcggccaccacgccttcagcgactac

SEQ ID NO: 4845 - DNA, 354 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccttggcctctctactgggcctgccagggctgcgtcctaaccggcgtctgggtcatagcccacgagtgcggccaccacgccttcagcgactac

SEQ ID NO: 4846 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagcctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctactcctctctactgggcctgccagggctgcgtcctaaccggcgtctgggtcatagcccacgagtgcggccaccacgccttcagcgactac

SEQ ID NO: 4847 - DNA, 341 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcattatagcctcctgcttctactacgtcgccaccacttacttccctctcctccctcaccctctctcctacctctactgggcctgccagggctgcgtcctaaccggcgtctgggtcatagcccacgagtgcggccaccacgccttcagcgactac

SEQ ID NO: 4848 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccagtgctgcgtcctaaccggcgtctgggtcatagcccacgagtgcggccaccgcgccttcagcgactac

SEQ ID NO: 4849 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcatccctcaccctctctcctactgcggcctctctactgggcctgccagggctgcgtcctaaccggcgtctgggtcatagcccacgagtgcggccaccacgccttcagcgactac

SEQ ID NO: 4850 - DNA, 352 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccgccctggcctctctactgggcctgccagggctgcgtcctaaccggcgtctgggtcatagcccacgagtgcggccaccacgccttcagcgactac

SEQ ID NO: 4851 - DNA, 334 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccagggctgcgtcctaaccggcgtctgggtcatagtccacgagtgcggccaccacgccttcagcgactac

SEQ ID NO: 4852 - DNA, 348 bp, Artificial
  Mutation in BnaA.FAD2.a introduced by TALE nuclease pair BnFAD2_T01
caggatccatgggtgcaggtggaagaatgcaagtttctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagccgcctgcttctactacgtcgccaccacttacttccctctcctccctcaccctctctcctaccaggcctctctactgggcctgccagggctgcgtcctaacctgcgtctgggtcatagcccaccagggcggccaccacgccttcagcgactac

SEQ ID NO: 4853 - DNA, 341 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtttactgggcctgccagggctgcgtcctaaccggcgtctgggtcatagcccacgagtgcggccaccacgccttcagcgactac

SEQ ID NO: 4854 - DNA, 438 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttcgccagctgggccttgtagttgcccttgaagtggccggacacgaacaggaacttgaactcggtcacgctggaggggtacaccttccacctggcctctctactgggcctgccaagggtgcgtcctaaccggcgtctgggtcatagcccacgagtgcggccaccacgccttcagcgactac

SEQ ID NO: 4855 - DNA, 348 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaaccggcgtctgggtcatagcccacgagtgcggccaccacgccttcagcgactac

SEQ ID NO: 4856 - DNA, 349 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgctaagggtgcgtcctaaccggcgtctgggtcatagcccacgagtgcggccaccacgccttcagcgactac

SEQ ID NO: 4857 - DNA, 374 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccaggcttatcttggacaagaagaagatcgctctctactgggcctgccaagggtgcgtcctaaccggcgtctgggtcatagcccacgagtgcggccaccacgccttcagcgactac

SEQ ID NO: 4858 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgccttggcctctctactgggcctgccagggctgcgtcctaaccggcgtctgggtcatagcccacgagtgcggccaccacgccttcagcgactac

SEQ ID NO: 4859 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccctcgcctctctactgggcctgccagggctgcgtcctaaccggcgtctgggtcatagcccacgagtgcggccaccacgccttcagcgactac

SEQ ID NO: 4860 - DNA, 339 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttactgggcctgccagggctgcggcctaaccggcgtctggttcatagcccacgagtgcggccaccacgccttcagcgactac

SEQ ID NO: 4861 - DNA, 358 bp, Artificial
  Mutation in BnaA.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttcccccggtctggcctctctactaggcctgccagggctgcgtcctagccggcgtctgggtcatagcccacgagtgcggccaccactcctgcagcgactac

SEQ ID NO: 4862 - DNA, 339 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccggcctgccagggctgcgtcctaaccggcgtctgggtcatagcccacgagtgcggccaccacgccttcagcgactac

SEQ ID NO: 4863 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttaccttagcccctctactaggcctgccaaggctgcgtcctaacgggcctctgggtcatcgcccacgaatgcggccaccacgccttcagcgactac

SEQ ID NO: 4864 - DNA, 338 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctccctcctattactgggcctgccagggctgcgtcctaaccggcgtctgggtcatagcccacgagtgcggccaccacgccttcagcgactac

SEQ ID NO: 4865 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaattcaagaaagcaatcccacctcactgtttcaaacgctcgatccctccctctttctcctacctcatctgggacatcatcacagcctcctgcttctactacgtcgccaccacttacttccctctcctccctcaccctctctcctatcgcctctctactgggcctgccagggctgcgtcctaaccggcgtctgggtcatagcccaccagtgcggccaccacgccttcagcgactac

SEQ ID NO: 4866 - DNA, 426 bp, Artificial
  Mutation in BnaA.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccccttacttccctctcctccctcaccctctcccctacttatggccgccacctccctctgatagttgagtcgatacttcggcgatcaccgcttcccccataatgtttaactttgttttggcctctctactgggcctgccagggctgcgtcctaacgggcctctgggtcatcgcccacgaatgcggccaccacgccttcagcgactac

SEQ ID NO: 4867 - DNA, 332 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgtttcaaacgctcgatccctcgctctttctcctacctcatctgggacatcatcatagcctcctgcttctactacgtcgccaccacttacttccctctcctccctcaccctctctactgggcctgccagggctgcgtcctaaccggcgtctgggtcatagcccacgagtgcggccaccacgccttcagcgactac

SEQ ID NO: 4868 - DNA, 340 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccagggctgcgtcctaaccggcgtctgggtcatagcccacgagtgtggccaccacgccttcagcgactac

SEQ ID NO: 4869 - DNA, 334 bp, Artificial
  Mutation in BnaA.FAD2.a introduced by TALE nuclease pair BnFAD2_T01
caggatccatgggtgcaggtggaagaatgcaagtgtctcctccatccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccagggctgcgtcctaaccggcgtctgggtcatagcccacgagtgcggccaccacgccctcagcgactac

SEQ ID NO: 4870 - DNA, 336 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctgggcctgccaaggctgcgtcctaacgggcctctgggtcatcgcccacgaatgcggccaccacgccttcagcgactac

SEQ ID NO: 4871 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctacttggcctgccaagggtgcgtcctaaccggcgtctgggtcatagcccacgagtgtggccaccacgccttcagcgactac

SEQ ID NO: 4872 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctgcctctctactgggcctgccagggctgcgtcctaacgggcctctgggtcatagcccacgagtgcggccaccacgccttcagcgactac

SEQ ID NO: 4873 - DNA, 347 bp, Artificial
  Mutation in BnaA.FAD2.a introduced by TALE nuclease pair BnFAD2_T01
caggatccatgggtgcaggtggaagaatgcaagtgtatcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 4874 - DNA, 356 bp, Artificial
  Mutation in BnaA.FAD2.a introduced by TALE nuclease pair BnFAD2_T01
caggatccatgggtgcaggtggaagaatgcaagtgtatcctccaaccaaaaagactgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccagggctgcgtcctaaccggcgtctgggtcatagcccacgagtgcggccaccacgccttcagcgactac

SEQ ID NO: 4875 - DNA, 358 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacactcgatccctcgctctttctcctacctcatctgggacatcatcatagcctcctgcttctactacgtcgccaccacttacttccctctcctccctcaccctctctcctacttcgccgggtctggcctctctactaggcctgccagggctgcgtcctaacgggcctcttggtcatagcccacgagtgcggccaccacgccttcagcgactac

SEQ ID NO: 4876 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtgccctgcgagacaccgcccttcactgtcggagaactcaagaaagcaatcccaccgcactgtttcaaacgctcgatccctcgctctttctcctacctcatctgtgacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 4877 - DNA, 358 bp, Artificial
  Mutation in BnaA.FAD2.a introduced by TALE nuclease pair BnFAD2_T01
caggatccatgggtgcaggtggaagaatgcaagtgtcacctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctcgcctggcctctctactgggcctgccagggctgcgtcctaaccggcgtctgggtcatagcccacgagtgcggccaccacgccttcggcgactac

SEQ ID NO: 4878 - DNA, 350 bp, Artificial
  Mutation in BnaA.FAD2.a introduced by TALE nuclease pair BnFAD2_T01
caggatccatgggtgcaggtggaagaatgcaagtgtctcctccctccagctcccccggaaccaacaccctcaaacgcgtcccctgcgagccaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactcggcctgccagggctgcgtcctaaccggcgtctgggtcatagcccacgagtgcggccaccacgccttcagcgactac

SEQ ID NO: 4879 - DNA, 331 bp, Artificial
  Mutation in BnaA.FAD2.a introduced by TALE nuclease pair BnFAD2_T01
caggatccatgggtgcaggtggaagaatgcaagtgtctcctccctccaaaaagactgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgggcctgccagggctgcgtcctaaccggcgtctgggtcatagcccacgagtgcggccaccacgccttcagcgactac

SEQ ID NO: 4880 - DNA, 342 bp, Artificial
  Mutation in BnaA.FAD2.a introduced by TALE nuclease pair BnFAD2_T01
cagatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgccttcagcgactac

SEQ ID NO: 4881 - DNA, 325 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttggctgcgtcctaaccggcgtctgggtcatagcccacgagtgcggccaccacgccttcagcgactac

SEQ ID NO: 4882 - DNA, 349 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaccatcaagcgcgtaccctgctagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 4883 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctggcctctctactgggcctgccagggctgcgtcctagccggcgtctgggtcatagcccacgagtgcggccaccacgccttcagcgactac

SEQ ID NO: 4884 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatcactcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 4885 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccagggctgcgtcctaacgggcctctgggtcatcgcccacgaatgcgaccaccacgccttcagcgactac

SEQ ID NO: 4886 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccctggcctctctactgggcctgccagggctgcgtcctaaccggcgtctgggtcatagcccacgagtgcggccaccaccccttcagcgactac

SEQ ID NO: 4887 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccaagggtgcgtcctaaccggcgtctgggtcatagcccacgagtgcggccaccacgccttcagctactac

SEQ ID NO: 4888 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgccgctctactgggcctgccagggctgcgtcctaaccggcggctgggtcatagcccacgagtgcggccaccacgccttcagcgactac

SEQ ID NO: 4889 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggcctgccagggctgcgtcctaaccggcgtctgggtcatagcccacgagtgcggccaccacgccttcagcgactac

SEQ ID NO: 4890 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcggcctctctactgggcctgccagggctgcgtcctaaccggcgtctgggtcatagcccacgagtgcggccaccacgccttcagcgactac

SEQ ID NO: 4891 - DNA, 341 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctactgggcctgccaagggtgtgtcctaaccggcgtctgggtcatagcccacgagtgcggccaccacgccttcagcgactac

SEQ ID NO: 4892 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctccatccctcgctccttctcctacctcatctgggacatcatcatagcctcctgcttctactacgtcgccaccacttacttccctctcctccctcaccctctctcctactttcctctctactgggcctgccaagggtgcgtcctaaccggcgtctgggtcatagcccacgagtgcggccaccacgccttcagcgactac

SEQ ID NO: 4893 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctagccggcgtctgggtcatagcccacgagtgcggccaccacgccggcggcgactac

SEQ ID NO: 4894 - DNA, 386 bp, Artificial
  Mutation in BnaA.FAD2.a introduced by TALE nuclease pair BnFAD2_T01
caggatccatgggtgcaggtggaagaatgcaagtgtctcctccctcccaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggccaccacctgctggggggtcaggccgtgggccgggcacagtctctactgggcctgccagggctgcgtcctaaccggcgtctgggtcatagcccacgagtgcggccaccacgccttcagcgactac

SEQ ID NO: 4895 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctactgtgcctgccagggctgcgtcctaaccggcgtctgggtcatagcccacgagtgcggccaccacgccttcagcgactac

SEQ ID NO: 4896 - DNA, 337 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacactgggcctgccagggctgcgtcctaaccggcgtctgggtcatagcccacgagtgcggccaccacgccttcagcgactac

SEQ ID NO: 4897 - DNA, 424 bp, Artificial
  Mutation in BnaA.FAD2.a introduced by TALE nuclease pair BnFAD2_T01
caggatccatgagtgcaggtggaagaatgcaagtgtctcctccatccaagaagactgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccccttacttccctctcctccctcaccctctctcctgctccgccaccgcctgcttcccgccatcgtggctggcgatggccaccgcctgctccggggtcaagcaggtggtggccactggcctctctactgggcctgccagggctgcgtcctaaccggcgtctgggtcatagcccacgagtgcggccaccacgccttcatcgactac

SEQ ID NO: 4898 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtcccctgcgagacaccacccttcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcggggcctctctactgggcctgccaagggtgcgtcctaacgggcctctgggtcatagcccacgagtgcggccaccacgccttcagcgactac

SEQ ID NO: 4899 - DNA, 349 bp, Artificial
  Mutation in BnaA.FAD2.a introduced by TALE nuclease pair BnFAD2_T01
caggatccatgggtgcaggtggaagaatgcaagtgtgtcctcccaccaagaagtctgaaaccgacaccatcaagcgcgtaccctgcgagacaccgcccttcactgtcgtagaactcaagaaagcactcccaccgcactgtttcaaacgctcgatccctcgctctttctcctacctcatctgggacgtcatcatagcctcctgcttctactacgtcgccaccacttacttccctctcctccctcaccctctctcctactttggcctctctactgcgcctgccagggctgcgtccgaaccggcgtcggggtcatagcccacgagtgcggccaccacgccgtcaacgactac

SEQ ID NO: 4900 - DNA, 411 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgtccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctactgaacgcaggaaagaacatgtgagcaaaaggccagcaaaaggccaggaaccgtaaaaaggccgcgggcctctctactgggcctgccagggctgcgtcctaaccggcgtctgggtcatagcccacgagtgcggccaccacgccttcagcgactac

SEQ ID NO: 4901 - DNA, 343 bp, Artificial
  Mutation in BnaA.FAD2.a introduced by TALE nuclease pair BnFAD2_T01
caggatccatgggtgcaggtggaagaatgcaagtgtatcctccctccaaaaagtctgaaactgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccagggctgcgtcctaaccggcgtctgggtcatagcccacgagtgcggccaccacgccttcagcgactac

SEQ ID NO: 4902 - DNA, 358 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttccctcgccgcgtctggcccctcgacgggggctgccaaggcggggggctaacgggccgctgggtcagcgcccacgagtgcggccaccacgccttcagcgactac

SEQ ID NO: 4903 - DNA, 331 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgggcctgccagggctgcgtcctaaccggcgtctgggtcatagcccacgagtgcggccaccacgccttcagcgactac

SEQ ID NO: 4904 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctcccctaggcctctctactgggcctgccagggctgcgtcctaacgggcctctgggtcatagcccacgagtgcggccaccacgccttcagcgactac

SEQ ID NO: 4905 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccatcatcgactac

SEQ ID NO: 4906 - DNA, 349 bp, Artificial
  Mutation in BnaA.FAD2.a introduced by TALE nuclease pair BnFAD2_T01
caggatccatgggtgcaggtggaagaatgaaagtgtctcctccctccaagaagtctgaaaccgacaccatcaagcgcgtaccctgcgagacaccgcccttcactgtcggtgaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcctctgggtcatagcccacgagtgcggccaccacgccttcagcgactac

SEQ ID NO: 4907 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctgtcctccctcaccctctctcctacttctggcctctctactgggcctgccagggctgcgtcctaaccggcctctgggtcatcgcccacgaatgcggccaccacgccgtcagcgactac

SEQ ID NO: 4908 - DNA, 350 bp, Artificial
  Mutation in BnaA.FAD2.a introduced by TALE nuclease pair BnFAD2_T01
caggatccatgggtgcaggtagaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctggcctctctactgtgcctgccagggctgcgtcctaaccggcgtctgggtcatagcccacgattgcggccaccacgccttcagcgactac

SEQ ID NO: 4909 - DNA, 318 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttggcaggcctctctactgggcctgccagggctgcgtcctaaccggcgtctgggtcatagcccacgagtgcggccaccacgccttcagcgactac

SEQ ID NO: 4910 - DNA, 351 bp, Artificial
  Mutation in BnaA.FAD2.a introduced by TALE nuclease pair BnFAD2_T01
caggatccatgggtgcaggtggaagaatgcaagtgtctcctgcatccaaaaagactgaacccgacaacatcaagcgcgtaccctgcgagacaccgcccttcactgtcggagaactcaagaaagcaatcccaccgcactgcttcaaacgctccatccctcgctccttctcctacctcctcttcgacatcctcgtctcctcctccctctaccacctctccacagcctacttccctctcctccctcaccctctctcctacttcgtggcctctctactgggcctgccaaggctgcgtcctaacgggcctctgggtcatagcccacgagtgcggccaccacgccttcagcgactac

SEQ ID NO: 4911 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccccctctcctacttcgcccctggcctctctactgggcctgccaagggtgcgtcctaaccggcgtctgggtcatagcccacgagtgcggccaccacgccttcagcgactac

SEQ ID NO: 4912 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaaggctgcgtcctaacgggcctctgggtcatcgcccacgaatgcggccaccacgccatcagcgactac

SEQ ID NO: 4913 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcttggcctctctactgggcctgccagggctgcgtcctaaccggcgtctgggtcatagcccacgagtgcggccaccacgccttcagcgactac

SEQ ID NO: 4914 - DNA, 345 bp, Artificial
  Mutation in BnaA.FAD2.a introduced by TALE nuclease pair BnFAD2_T01
caggatccatgggtgcaggtggaagaatgcaagtgtatcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcacctaggcctctctactgggcgtgccaagggtgcgtcctaacgggcctctgggtcatcgcccacgaatgcggccaccacgccttcagcgactac

SEQ ID NO: 4915 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccacctcactgcttcaaacgctccatcccacgctcctcctcctcttcgacatcatcatctcctcctcggctcctccctctaccacctctccacagcctacttccctctcctccctcaccctctctcctacgtctggcctctctactgggcctgccagggctgcgtcctaaccggcgtctgggtcatagcccacgagtgcggccaccacgccttcagcgactac

SEQ ID NO: 4916 - DNA, 471 bp, Artificial
  Mutation in BnaA.FAD2.a introduced by TALE nuclease pair BnFAD2_T01
caggatccatgggcgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttgcttttttataatcccaactctatacaaaaaagcaggcttaggtccctcgcgaacgcatctagacccaatgatcaggagctgagaatgggcctggcacagcaccggcaacagccgctggacctggcctctctactgggcctgccagggctgcgtcctaaccggcgtctgggtcatagcccacgagtgcggccaccacgccttcagcgactac

SEQ ID NO: 4917 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccccgcctctctactgggcctgccaagggtgcgtcctaaccggcgtctgggtcatagcccacgagtgcggccaccacgccttcagcgactac

SEQ ID NO: 4918 - DNA, 349 bp, Artificial
  Mutation in BnaA.FAD2.a introduced by TALE nuclease pair BnFAD2_T01
caggatccatgggtgcaggtggaagaatgcaagtgtcacctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgggcctctctactgggcctgccagggctgcgtcctaaccggcgtctgggtcatagcccacgagtgcggccaccacgccttcagcgactac

SEQ ID NO: 4919 - DNA, 334 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgctgccaagggtgcgtcctaaccggcgtctgggtcatatcccacgagtgcggccaccacgccttcagcgactac

SEQ ID NO: 4920 - DNA, 348 bp, Artificial
  Mutation in BnaA.FAD2.a introduced by TALE nuclease pair BnFAD2_T01
caggatccatgggtgcagggggaagaatgcaagtgtctcctccatcccaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgcgcctgccagggctgcgtcctaaccggcttctgggtcatagcccacgagtgcggctgccacgccttcagcgactac

SEQ ID NO: 4921 - DNA, 341 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgggcctgccagggctgcgtcctaaccggcgtctgggtcatagcccacgagtgcggccaccacgccttcagcgactac

SEQ ID NO: 4922 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaaggctgcgtcctaacgggcctctgggtcatcgcccgcgaatgcggccaccacgccttcagcgactac

SEQ ID NO: 4923 - DNA, 349 bp, Artificial
  Mutation in BnaA.FAD2.a introduced by TALE nuclease pair BnFAD2_T01
caggatccatgggtgcaggtcgaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgttggcctctctactgggcctgccagggctgtgtcctaaccggcgtctgggtcatagcccacgagtgcggccaccacgccttcagcgactac

SEQ ID NO: 4924 - DNA, 348 bp, Artificial
  Mutation in BnaA.FAD2.a introduced by TALE nuclease pair BnFAD2_T01
caggatccatgggtgcaggtggaagaatgcaagtgtctcatccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctccctaacctggcccctctactgggcctgccaaggctgcgtcctaacgggcctctgggtcatcgctcgcgaatgcggcctccacgccatcagcgactac

SEQ ID NO: 4925 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacttcgccctctctactgggcctgccaagggtgcgtcctaccggcgtctgggtcatagcccacgagtgcggccaccacgccttcagcgactac

SEQ ID NO: 4926 - DNA, 349 bp, Artificial
  Mutation in BnaA.FAD2.a introduced by TALE nuclease pair BnFAD2_T01
caggatccatgggtgcagggggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcggcctctctactgggccggccagggctgcgtcctaacgggcctctgggtcagagcccacgagtgctgccaccacgccttcagcgactac

SEQ ID NO: 4927 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatatcctcctgcttctactacgtcgccaccacttacttccctctcctccctcaccctctctcctacttcgtggcctctctactgggcctgccagggctgcgtcctaaccggcgtctgggtcatagcccacgagtgcggccaccacgccttcagcgactac

SEQ ID NO: 4928 - DNA, 339 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcatctgggacatcatcatagcctcctgcttctactacgtcgccaccacttacttccctctcctccctcaccctctctcctacttactgggcctgccagggctgcgtcctaaccggcgtctgggtcatagcccacgagtgcggccaccacgccttcagcgactac

SEQ ID NO: 4929 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacttggcctctctactgggcctgccaaggctgcgtcctaacgggcctctgggtcatcgcccacgagtgcggccaccacgccttcagcgactac

SEQ ID NO: 4930 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcccccctcaccctctctcctacgtcggcctctctactgcgcctgccagggctgcgtcctaaccggcgtctgggtcatagcgcacgagtgcggccgccacgccttcagcgactac

SEQ ID NO: 4931 - DNA, 350 bp, Artificial
  Mutation in BnaA.FAD2.a introduced by TALE nuclease pair BnFAD2_T01
caggatccatgggtgcaggtgcaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccgcgagtgcggccaccacgccttcagcgactac

SEQ ID NO: 4932 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgcttgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 4933 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcattcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 4934 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacttgcctctctactgggcctgccaagggtgcgtcctaaccggcgtctgggtcatagcccacgagtgcggccaccacgccttcagcgactac

SEQ ID NO: 4935 - DNA, 335 bp, Artificial
  Mutation in BnaA.FAD2.a introduced by TALE nuclease pair BnFAD2_T01
caggatccatgggtgcaggtggaagaatgcaagtgtatcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcctctctactgggcctgccagggctgcgtcctaaccggcgtctgggtcatagcccacgagtgcggccaccacgccttcagcgactac

SEQ ID NO: 4936 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctgcctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 4937 - DNA, 348 bp, Artificial
  Mutation in BnaA.FAD2.a introduced by TALE nuclease pair BnFAD2_T01
caggatccatgggtgcaggtggaagaatgcaagtgtcacctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacttcgcctctctactgggcctgccagggctgcgtcctaaccggcgtctgggtcatagcccacgagtgcggccaccacgccttcagcgactac

SEQ ID NO: 4938 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcagagcccacgagtgcggccaccacgccttcagcgactac

SEQ ID NO: 4939 - DNA, 349 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatcgcccacgaatgcggccaccacgccttcagcgactac

SEQ ID NO: 4940 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacttctggcctctctactgggcctgccagggctgcgtcctaaccggcgtctgggtcatagcccacgagtgcggccaccacgccatcagcgactac

SEQ ID NO: 4941 - DNA, 350 bp, Artificial
  Mutation in BnaA.FAD2.a introduced by TALE nuclease pair BnFAD2_T01
caggatccatggggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctctctactgggcctgccagggctgcgtcctaaccggcgtctgggtcatagcccacgagtgcggccaccacgccatcagcgactac

SEQ ID NO: 4942 - DNA, 356 bp, Artificial
  Mutation in BnaA.FAD2.a introduced by TALE nuclease pair BnFAD2_T01
caggatccatgggtgcaggtcgaagaatgcaagtgtctcctccatccaaaaagcctgaacccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccacgccttcagcgactac

SEQ ID NO: 4943 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctcctcgcctctctactgggcctgccagggctgcgtcctaaccggcgtctgggtcatagcccacgagtgcggccaccacgccttcagcgactac

SEQ ID NO: 4944 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgctggcctctctactgggcctgccaagggtgcgtcctaactggcctctgggtcatagcccacgagtgcggcctccacgccttcagcgactac

SEQ ID NO: 4945 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccagggctgcgtcctaaccggcgtctgggtcatagcccacgagtgcggccaccacgccatcagcgactac

SEQ ID NO: 4946 - DNA, 329 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaacgacaacatcaagcgcgtaccctacgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctccgccctcaccctctcttggcctgccagggctgcgtcctaactggcctctgggtcatagccctcgagttctgccaccacgccttcatcgactac

SEQ ID NO: 4947 - DNA, 348 bp, Artificial
  Mutation in BnaA.FAD2.a introduced by TALE nuclease pair BnFAD2_T01
caggatccatgggtgcaggtggaagaatgcaagtgtctcctccctcccaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactaggcctctctactgggcctgccagggctgcgtcctaaccggcgtctgggtcatagcccacgagtgcggccaccgcgccatcagcgactac

SEQ ID NO: 4948 - DNA, 340 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttctctctcctccctcaccctctctcctactttactgggcctgccagggctgcgtcctaaccggcgtctgggtcatagcccacgagtgcggccaccacgccttcagcgactac

SEQ ID NO: 4949 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcctctctactgggcctgccagggctgcgtcctaaccggcgtctgggtcatagcccacgagtgcggccaccacgccttcagcgactac

SEQ ID NO: 4950 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagagcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttctctctcctccctcaccctctctcctacttggcctctctactgggcctgccagggctgcgtcctaaccggcgtctggggcatagcccacgagtgcggccaccacgccttcagcgactac

SEQ ID NO: 4951 - DNA, 356 bp, Artificial
  Mutation in BnaA.FAD2.a introduced by TALE nuclease pair BnFAD2_T01
caggatccatgggtgcaggtggaagaatgcaagtgtctcacccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgacgcctggcctctctactgggcctgccaagggtgcgtcctaacgggcctctgggtcatagcccacgagtgcggcgaccacgccttcagcgactac

SEQ ID NO: 4952 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagactgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccagggctgcgtcctaaccggcgtctgggtcatagcccacgagtgcggccaccacgccttcagcgactac

SEQ ID NO: 4953 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccagggctgcgtcctaaccggcgtctgggtcatagcccacgagtgcggccaccacgccttcagcgactac

SEQ ID NO: 4954 - DNA, 354 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacacagcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccttggcctctctactgggcctgccagggctgcgtcctaaccggcgtctgggtcatagcccacgagtgcggccaccacgccttcagcgactac

SEQ ID NO: 4955 - DNA, 352 bp, Artificial
  Mutation in BnaA.FAD2.a introduced by TALE nuclease pair BnFAD2_T01
caggatccatgggtgcatgtggaagaatgcaagtgtctcatccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggcctctctactgggcctgccaagggtgcgtcctaaccggcgtctgggtcatagcccacgagtgcggccgccacgccttcagcgactac

SEQ ID NO: 4956 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagtgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggcctgccaagggtgcgtcctaaccggcgtctgggtcatagcccacgagtgcggccaccacgccttcagcgactac

SEQ ID NO: 4957 - DNA, 349 bp, Artificial
  Mutation in BnaA.FAD2.a introduced by TALE nuclease pair BnFAD2_T01
caggatccatgggtgcagggggaagaatgcaagtgtctcctacctacaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccttggcctctctactgagccggccaagggtgcgtcctaaccggcgtctgggtcatagcccacgagtggggtcaccacgccttcagcgactac

SEQ ID NO: 4958 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacagctagcctctctcctgggcctgccaaaggtgcgtcctgaccggcgtcgggggcatagcccacaagtgcggccaccacgccatgagcaactgc

SEQ ID NO: 4959 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctccctcaccctctctcctacttctggcctctctactgggcctgccaagggtgcgtcctaaccggcgtctgggtcatagcccacgagtgcggccaccacgccttcagcgactac

SEQ ID NO: 4960 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagcctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacaggcctctctactgggcctgccagggctgcgtcctaaccggcgtctgggtcatagcccacgagtgcggccaccacgccttcagcgactac

SEQ ID NO: 4961 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccagggctgcgtcctaacgggcctctgggtcatagcccacgagtgcggccaccacgccttcagcgactac

SEQ ID NO: 4962 - DNA, 340 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgctagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttactgggcctgccagggctgcgtcctaaccggcgtctgggtcatagcccacgagtgcggccaccacgccttcagcgactac

SEQ ID NO: 4963 - DNA, 347 bp, Artificial
  Mutation in BnaA.FAD2.a introduced by TALE nuclease pair BnFAD2_T01
caggatccatgggtgcaggtcgaagaatgcaagtgcctcctccctccaaaaagtctgaaaccgacaacatcaagcgcgtaccctgcgagacaccgcccttcactgtcggagaactcaagaaagcaatcccaccacactgtttcaaacgctcgatccctcgctctttctcctacctcatctgggacatcatcatagcctcctgcttctactacgtcgccaccacttacttccctctcctccctcaccctctctcctacttgcctctctactgggcctgccagggctgcgtcctaaccggcgtctgggtcatagcccacgagtgcggccaccacgccttcagcgactac

SEQ ID NO: 4964 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccccacttctctactgggcctgccagggctgcgtcctaaccggcgtctgggtcatagccctcgagtgcggccaccacgccttcagcgactac

SEQ ID NO: 4965 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcggcctctctactgggcctgccagggctgcgtcctaaccggcgtctgggtcatagcccacgagtgcggccaccacgccttcagcgactac

SEQ ID NO: 4966 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacttcgcctgggcctgccagggctgcgtcctaacgggcgtctgggtcatggcccacgagtgcggccaccacgccttcagcgactac

SEQ ID NO: 4967 - DNA, 354 bp, Artificial
  Mutation in BnaA.FAD2.a introduced by TALE nuclease pair BnFAD2_T01
caggatccaggggtgcaggtggaagaatgcaagtctctcaccccttcagctcccccggaaccaacaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttgcctctcctccctcaccctctctcctactttcgcctggcctctctactgagcctgccagggctgcgtcctaaccggcgtcggggtgattgcccgccagtgcggtctccacgccttcagccactac

SEQ ID NO: 4968 - DNA, 341 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctactgggcctgccagggctgcgtcctaaccggcgtctgggtcatagcccacgagtgcggccaccacgccttcagcgactac

SEQ ID NO: 4969 - DNA, 348 bp, Artificial
  Mutation in BnaA.FAD2.a introduced by TALE nuclease pair BnFAD2_T01
caggatccatgggtgcaggtcgaagaatgcaagtgtcccctccctccaaaaagcctgaacccgacaccatcaagcgcgtaccctgcgagacaccgcccttcactgtcggagaactcaagcaagcaatcccaccgcactgtttcaaacgctcgatccctcgctctttctcctacctcatctgggacatcatcatagcctcctgcttctactacgtcgccaccactgacttccctctcctccctcaccctctctccgacttggcctctctactgggcctgccagggctgcgtcctaaccggcgtctgggttatagcctacgagtgcggctaccacgccttcagcgactac

SEQ ID NO: 4970 - DNA, 348 bp, Artificial
  Mutation in BnaA.FAD2.a introduced by TALE nuclease pair BnFAD2_T01
caggatccatgggtgcaggtggaagaatgcaagtgtatcctccctccaaaaagtctgaaaccgacaacatcaagcgcgtaccctgcgagacaccgcccttcactgtcggagaactcaagaaagcaatcccacctcactgcttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcacgactac

SEQ ID NO: 4971 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagcctgaaacctacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggccggccaagggtgcgtcctaaccggcgtctgggtcatagcccacgagtgcggccaccacgccttcagcgactac

SEQ ID NO: 4972 - DNA, 356 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctactccgccgcctggcctctctactgggcctgccaagggtgcgtcctaacgggcctctggggcatagcccacgagtgcggccaccgcgccatcagcgactac

SEQ ID NO: 4973 - DNA, 344 bp, Artificial
  Mutation in BnaA.FAD2.a introduced by TALE nuclease pair BnFAD2_T01
caggatccatgggtgcaggtggaagaatgcaagtgtctccttcctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccagggctgcgtcctaaccggcgtctggggcatagcccgcgagtgctgcgaccgcgccatcagcgactac

SEQ ID NO: 4974 - DNA, 351 bp, Artificial
  Mutation in BnaA.FAD2.a introduced by TALE nuclease pair BnFAD2_T01
caggatccatgggtgcaggtggaagaatgcaagtctctcctccctccaaaaagactgaaaccgacaacatcaagcgcgtaccctgcgagacaccgcccttcactgtcggagaactcaagaaagcaatcccaccgcactgtttcaaacgctcgatccctcgctccttctcctacctcctcttcgacatcctcgtctcctcctccctctaccacctctccacagcctacttccctctcctccctcaccctctctcctccttcgcggcctctctactgggcctgccagggctgcgtcctaaccggcctctgggtcatagcccacgagtgcggccaccacgccttcagcgactac

SEQ ID NO: 4975 - DNA, 339 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgccgccaccacttacttccctctcctccctcaccctctggcctctctactgggcctgccaagggtgcgtcctaacgggcctctgggtcatagcccacgagtgcggccaccacgccttcagcgactac

SEQ ID NO: 4976 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaattccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccaaggctgcgtcctaacgggcctctgggtcatagcccacgagtgcggccaccacgccttcagcgactac

SEQ ID NO: 4977 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagcctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaaggctgcgtcctaacgggcctctgggttatagcccacgagtgcggccaccacgccttcagcgactac

SEQ ID NO: 4978 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctactgggcctgccagggctgcgtcctaaccggcgtctgggtcatagcccacgagtgcggccaccacgccttcagcgactac

SEQ ID NO: 4979 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgaatgcggccaccacgccttcagcgactac

SEQ ID NO: 4980 - DNA, 430 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcctctactacgtcgccaccacttacttccctctcctccctcaccctctctcctacttatgtacggccagcaacgtcggttcgagatggcgctcgatgacgccaacgatggccaccacctgctccggggtcaagccagttggcctctctactgggcctgccagggctgcgtcctaaccggcgtctgggtcatagcccacgagtgcggccaccacgccttcagcgactac

SEQ ID NO: 4981 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggcttcgtcctaaccggcgtctgggtcatagcccacgagtgcggccaccacgccttcagcgactac

SEQ ID NO: 4982 - DNA, 355 bp, Artificial
  Mutation in BnaA.FAD2.a introduced by TALE nuclease pair BnFAD2_T01
caggatccatgggtgcaggtgaaagaatgcaagtgtctcctcccaccaaaaagtctgaaaacgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccccgggcctctctactgagcctgccagggctgcgtcctaaccggcgtctgggtcatagcccacgagtgcggccaccacgccttcagcgactac

SEQ ID NO: 4983 - DNA, 347 bp, Artificial
  Mutation in BnaA.FAD2.a introduced by TALE nuclease pair BnFAD2_T01
caggatccatgggtgcaggtgaaagaatgcaagtgtatcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccagggctgcgtccgaacgggcctctgggtcatcgcccacgagtgcggccaccacgccttcagcgactac

SEQ ID NO: 4984 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttgcctctctactgggcctgccaagggtgcgtcctaaccggcgtctgggtcatagcccacgagtgcggccaccacgccttcagcgactac

SEQ ID NO: 4985 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctaccacgtcgccaccacttacttccctctcctccctcaccctctctcctaccgcgtggcctctctactgggcctgccagggctgcgtcctaaccggcgtctgggtcatagcccacgagtgcggccaccacgccttcagcgactac

SEQ ID NO: 4986 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcggcctctctactgggcctgccaagggtgcgtcctaaccggcgtcggggtcatagcccacgagtgcggccaccacgccttcagcgactac

SEQ ID NO: 4987 - DNA, 348 bp, Artificial
  Mutation in BnaA.FAD2.a introduced by TALE nuclease pair BnFAD2_T01
caggatccatgggtgcaggtggaagaatgcaagtgtctcatccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgccttggcctctctactgggcctgccaagagtgcgtcctaaccggcgtctgggtcatagcccacgagtgcggccaccacgccttcagcgactac

SEQ ID NO: 4988 - DNA, 343 bp, Artificial
  Mutation in BnaA.FAD2.a introduced by TALE nuclease pair BnFAD2_T01
caggatccatgggtgcaggtggaagaatgcaagtgtctcatccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccaagggtgcgtccgaaccggagtctgggtcatagcccacgatttcggcgaccacgccatcagcaactac

SEQ ID NO: 4989 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccccctggcctctctactgggcctgccagggctgcgtcctaaccggcgtctgggtcatagcccacgagtgcggccaccacgccttcagcgactac

SEQ ID NO: 4990 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttcctctctactgggcctgccaagggtgcgtcctaaccggcttctgggtcatagcccacgagtgcggccaccacgccttcagcgactac

SEQ ID NO: 4991 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctaactcatctgggacatcatcatagcctcctgcttctactgcgtcgccaccacttacttccctctcctccctcaccctctctcctacttggcctctctactgggcctgccaagggtgcgtcctaaccggcgtctgggtcatagcccacgagtgcggccaccacgccatcagcgactac

SEQ ID NO: 4992 - DNA, 352 bp, Artificial
  Mutation in BnaA.FAD2.a introduced by TALE nuclease pair BnFAD2_T01
caggatccatgggtgcaggtggaagaatgcaagtgtctcctcccttcaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgctagcctctctactgggcctgccagggctgcgtccaaaccggcgtctgggtcatagcccacgagtgctgccaccacgccatcagcgactac

SEQ ID NO: 4993 - DNA, 345 bp, Artificial
  Mutation in BnaA.FAD2.a introduced by TALE nuclease pair BnFAD2_T01
caggatccatgggtgcaggcggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctaggcctctctactgggcctgccagggctgcgtcctaaccggcgtctgggtcatagcccacgagtgcggccaccacgccttcagcgactac

SEQ ID NO: 4994 - DNA, 349 bp, Artificial
  Mutation in BnaA.FAD2.a introduced by TALE nuclease pair BnFAD2_T01
caggatccatgggtgcaggtggaagaatgcaagtgtatccaccatccaaaaagtctgaaaacgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctggcctctctactgggcctgccaagggtgcgtcctaaccggcgtctgggtcatagcccacgagtgcggccaccacgccttcagcgactac

SEQ ID NO: 4995 - DNA, 344 bp, Artificial
  Mutation in BnaA.FAD2.a introduced by TALE nuclease pair BnFAD2_T01
caggatccatgggtgcaggtggaagaatgcaagtgtctcatccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccagggctgcgtcctaaccggcgtctgggtcatagcccacgagtgcggccaccacgccttcagcgactac

SEQ ID NO: 4996 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttgcctctcctccctctccctctcccctacctctctactgggcctgccagggctgcgtcctaaccggcgtctgggccatagcccacgagtgcggccaccacgccttcagcgactac

SEQ ID NO: 4997 - DNA, 341 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctactgggcctgccaaggctgcgtcctaacgggcctctgggtcatagcccacgagtgcggccaccacgccttcagcgactac

SEQ ID NO: 4998 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccagggctgcgtcctaaccggcgtctggatcatagcccacgagtgcggccaccacgccttcagcgactac

SEQ ID NO: 4999 - DNA, 332 bp, Artificial
  Mutation in BnaA.FAD2.a introduced by TALE nuclease pair BnFAD2_T01
caggatccatgggtgcaggtggaagaattcaagtttttcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccagggctgcgtcctaaccggcgtctgggtcataacccacgagtgcggccaccacgccttcagcgactac

SEQ ID NO: 5000 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccggcctctctactgggcctgccagggctgcgtcctaaccggcgtctgggtcatagcccacgagtgcggccaccacgccttcagcgactac

SEQ ID NO: 5001 - DNA, 348 bp, Artificial
  Mutation in BnaA.FAD2.a introduced by TALE nuclease pair BnFAD2_T01
caggatccatgggtgcaggtagaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcttctgggtcatagcccacgagtgcggccaccacgccttcatcgactac

SEQ ID NO: 5002 - DNA, 277 bp, Artificial
  Mutation in BnaA.FAD2.a introduced by TALE nuclease pair BnFAD2_T01
caggatccatgggtgcaggtggaagaatgcaagtgtctccaccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacgccttcagcgactac

SEQ ID NO: 5003 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccagggctgcgtcctaaccggcgtctgggtcatagcccacgagtgcggccaccacgccttcagcgactac

SEQ ID NO: 5004 - DNA, 345 bp, Artificial
  Mutation in BnaA.FAD2.a introduced by TALE nuclease pair BnFAD2_T01
caggatccatgggtgcaggtggaagaatgcaagtgtctcctccccccaaaaagtctgaacccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccagggctgcgtccgaaccggcgtctgggtcatagcgctcgagtgcggccaccacgccttcagcgactac

SEQ ID NO: 5005 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccccttacttccctctcctccctcaccctctccccctggcctctctactgggcctgccaagggtgcgtcctaaccggcgtctgggtcatagcccacgagtgcggccaccacgccttcagcgactac

SEQ ID NO: 5006 - DNA, 378 bp, Artificial
  Mutation in BnaA.FAD2.a introduced by TALE nuclease pair BnFAD2_T01
caggatccatgggtgcaggtggaagaatgcaagtgtctcctccatccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctttgatccggttcctgaacaggatctatttgatggcccctctactgggcctgccaaggctgcgtcctaacgggcctctgggtcatcgcccacgaatgcggccaccacgccttcagcgactac

SEQ ID NO: 5007 - DNA, 350 bp, Artificial
  Mutation in BnaA.FAD2.a introduced by TALE nuclease pair BnFAD2_T01
caggatccatgggtgcaggtggaagaatgcaagtgtctccctcctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgctgccaccacgccttcagcgactac

SEQ ID NO: 5008 - DNA, 347 bp, Artificial
  Mutation in BnaA.FAD2.a introduced by TALE nuclease pair BnFAD2_T01
caggatccatggatgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccagggctgcgtcctaaccggcgtctgggtcatagcccacgagtgcggccaccacgccttcagcgactac

SEQ ID NO: 5009 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcgaagaactcaagaaagcaatcccaccgcactgtttcaaacgctcgatccctcgctctttctcctacctcatctgggacatcatcatagcctcctgcttctactacgtcgccaccacttacttccctctcctccctccccccctcccccacttggcctctctactgggcctgccagggctgcgtcctaaccggcgtctgggtcatagcccacgagtgcggccaccacgccttcagcgactac

SEQ ID NO: 5010 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactatttcaaacgctcgatccctcgctctttctcctacctcatctgggacatcatcatagcctcctgcttctactacgtcgccaccacttacttccctctcctccctcaccctctctcctatggcctctctactgggcctgccagggctgcgtcctaaccggcgtctgggtcatagcccacgagtgcggccaccacgccttcagcgactac

SEQ ID NO: 5011 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacttgcctctctactgggcctgccaagggtgcgtcctaaccggcgtctggggcatagcccgcgagtgctgccaccacgccttcatcgactac

SEQ ID NO: 5012 - DNA, 398 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgccttggcaacgctgcgatcatgtcctgatacttgacagcgacggtccctggcctctctactgggcctgccaagggtgcgtcctaaccggcgtctgggtcatagcccacgagtgcggccaccacgccttcagcgactac

SEQ ID NO: 5013 - DNA, 387 bp, Artificial
  Mutation in BnaA.FAD2.a introduced by TALE nuclease pair BnFAD2_T01
caggatccatgggtgcaggtggaagaatgcaagtgtttcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgccatcgtggctggcgatggccaccacctgctcctggcctctctactgggcctgccaagggtgcgtcctaaccggcgtctgggtcatagcccacgagtgcggccaccacgccttcagcgactac

SEQ ID NO: 5014 - DNA, 329 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcccccctcaccctctctcggcctgccagggctgcgtcctaaccggcgtctgggtcatagcccacgagtgcggccaccacgccttcagcgactac

SEQ ID NO: 5015 - DNA, 339 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttactgggcctgccagggctgcgtcctaacgggcctctgggtcatcgcccacgaatgcggccaccacgccttcagcgactac

SEQ ID NO: 5016 - DNA, 348 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcctctactacgtcgccaccacttacttccctctcctccctcaccctctctcccacttggcctctctactgggcctgccagggctgcgtcctaaccggcgtctgggtcatagcccacgagtgcggccaccacgccttcagcgactac

SEQ ID NO: 5017 - DNA, 348 bp, Artificial
  Mutation in BnaA.FAD2.a introduced by TALE nuclease pair BnFAD2_T01
caggatccatgggtgcaggtagaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 5018 - DNA, 335 bp, Artificial
  Mutation in BnaA.FAD2.a introduced by TALE nuclease pair BnFAD2_T01
caggatccatgggtgcaggtggaagaatgcaagtgtctcccacctccaaaaagactgaaaacgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccagggctgcgtccgaaccggcgtcggggtcatagcccacgagtgcggccaccgcgccttcagcgactac

SEQ ID NO: 5019 - DNA, 349 bp, Artificial
  Mutation in BnaA.FAD2.a introduced by TALE nuclease pair BnFAD2_T01
caggatccatgggtgcaggtggaagaatgcaagtgtctcctccatccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctggcctctctactgggcctgccaagggtgcgtcctaactggcgtctgggtcatagcccacgagtgcggccaccacgccttcagcgactac

SEQ ID NO: 5020 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcttagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 5021 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccatcagcgactac

SEQ ID NO: 5022 - DNA, 331 bp, Artificial
  Mutation in BnaA.FAD2.a introduced by TALE nuclease pair BnFAD2_T01
caggatccatgggtgcagggggaagaatgcaagtgtctccttcctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgcgcctgccagggctgcgtcctcaccggcgtctgggtcatagcccacgagtgcggctactacgccttcagcgactac

SEQ ID NO: 5023 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggataactcaagaaagcaatcccaccgcactgtttcaaacgctcgatccctcgctctttctcctacctcatctgggacatcatcatagcctccttcttctactacgtcgccaccacttacttccctctcctccctcaccctctctcaggcctctctactgggcctgccaagggtgcgtcctaaccggcgtctgggtcatagcccacgagtgcggccaccacgccttcagcgactac

SEQ ID NO: 5024 - DNA, 358 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctcgcctggcctctctactgggcctgccaagggtgcgtcctaaccggcgtctgggtcatagcccacgagttcggccaccacgccttcagcgactac

SEQ ID NO: 5025 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttcactctcctccctcaccctctctcctacttctcgcctctctactgggcctgccaggcctgcgtcctaaccggcgtctgggtcatagcccgcgagtgctgccaccacgccatcagcgactac

SEQ ID NO: 5026 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagactgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 5027 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgcttcaaacgctccatccctcgctctttctcctacctcatctgggacatcatcatagcctcctgcttctactacgtcgccaccacttacttccctctcctccctcaccctctctcctacttttggcctctctactgggcctgccaagggtgcgtcctaaccggcgtctgggtcatagcccacgagtgcggccaccacgccttcagcgactac

SEQ ID NO: 5028 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgagtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccacctcttacttccctctcctccctcaccctctctcctacttcctctctactgggcctgccagggctgcgtcctaaccggcgtctgggtcatagcccacgagtgcggccaccacgccatcagcgactac

SEQ ID NO: 5029 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagactgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgcgcctgccagggctgcgtcctaaccggcgtctgggtcatagcccacgagtgcggccaccacgccttcagcgactac

SEQ ID NO: 5030 - DNA, 436 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctggctggcgatggccaccccctgctccggggtcaagccgtgggcctggcatctctgccaaatagttgggagccaatgagggcaggcctctctactgggcctgccagggctgcgtcctaaccggcgtctgggtcatagcccacgagtgcggccaccacgccttcagcgactac

SEQ ID NO: 5031 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaaggctgcgtcctaaccggcgtctgggtcatagcccacgagtgcggccaccacgccttcagcgactac

SEQ ID NO: 5032 - DNA, 349 bp, Artificial
  Mutation in BnaA.FAD2.a introduced by TALE nuclease pair BnFAD2_T01
caggatccatgggtgcatgtggaagaatccaagtccttcgcccctcctgctcccccgaacccaaaaccctcaaacgcgtcccctgcgagacaccacccttcactctcggagacctcaagaaagcaatcccacctcactgcttcaaacgctcgatccttcgctctttctcctacctcatctgggacatcatcatagcctcctgcttctactacgtcgccaccacttacttccctctcctccctcaccctctctcctacgttggcctctctactgggcctgccggggctgcgtcctatccggcgtctgggtcatagcccacgagtgcggcccccacgccttctgcgactac

SEQ ID NO: 5033 - DNA, 349 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcagagacctcaagaaagcaatcccaccgcactgtttcaaacgctcgatccctcgctctttctcctaccgcatctgggacatcatcatagcctcctgcttctactacgccgccaccacttacttccctctcctccctcaccctctctcctcccttggcctctctactgggcctgccagggctgcgtcctaaccggcgtctgggtcatagcccacgaatgcggccaccacgccttcagcgactac

SEQ ID NO: 5034 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcataatagcctcctgcttctactacgtcgccaccacttacttccctctcctccctcaccctctctcctacctctctactgggcctgccagggctgcgtcctaacgggcctctgggtcatagcccacgagtgcggccaccacgccttcagcgactac

SEQ ID NO: 5035 - DNA, 347 bp, Artificial
  Mutation in BnaA.FAD2.a introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcacgactac

SEQ ID NO: 5036 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgtcaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 5037 - DNA, 357 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctatttctcctacctcatctgggacatcatcatagcctcctgcttctactacgtcgccaccacttacttccctctcctccctcaccctctctcctacttcgcgcgcctggcctctctactgggcctgccagggctgcgtcctaaccggcgtctgggtcatagcccacgagtgcggccaccacgccttcagcgactac

SEQ ID NO: 5038 - DNA, 334 bp, Artificial
  Mutation in BnaA.FAD2.a introduced by TALE nuclease pair BnFAD2_T01
caggatccatgggtgcaggtggaagaatgcaagtgtctcctccatacaaaaagactgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcacccactctctactgggcctgccagggctgcgtcctaaccggcgtctgggtcatagcccacgagtgcggccaccacgccttcagcgactac

SEQ ID NO: 5039 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctgacccctctactgggcctgccagggctgcgtcctaaccggcgtctgggtcatagcccacgagtgcggccaccacgccttcagcgactac

SEQ ID NO: 5040 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctcctctctactgggcctgccaaggctgcgtcctaacgggcctctgggtcatagcccacgagtgcggccaccacgccttcagcgactac

SEQ ID NO: 5041 - DNA, 378 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctccagcgcctgcttgccgccatcgtggctggcgatggccaccacctgctccggggtcaagtcgtgagggctgggtcatagcccacgagtgcggccaccacgccttcagcgactac

SEQ ID NO: 5042 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccagggctgcgtcctaaccggcgtctgggtcatagcccacgagtgcggccaccacgccttcagcgactac

SEQ ID NO: 5043 - DNA, 318 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttggcaggcctctctactgggcctgccaaggctgcgtcctaacgggcctctgggtcatagcccacgagtgcggccaccacgccttcagcgactac

SEQ ID NO: 5044 - DNA, 345 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacgcctctctactgggcctgccagggctgcgtcctaaccggcgtctgggtcatagcccacgagtgcggccaccacgccttcagcgactac

SEQ ID NO: 5045 - DNA, 429 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgggcgtcctgcccgccaccctccgggccgttgcttcacaccatcgtggctggcgatggccaccacctgctccggggtcatggcctctctactgggcctgccagggctgcgtcctaaccggcgtctgggtcatagcccacgagtgcggccaccacgccttcagcgactac

SEQ ID NO: 5046 - DNA, 341 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgggcctgccagggctgcgtcctaaccggcgtctgggtcatagcccacgagtgcggccaccacgccttcagcgactac

SEQ ID NO: 5047 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccaagggtgcgtcctaacgggcctctgggtcatagcccacgagtgcggccaccacgccttcagcgactac

SEQ ID NO: 5048 - DNA, 430 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttatgtacggccagcaacgtcggttcgagatggcgctcgatgacgccaacgatggccaccacctgctccggggtcaagccagttggcctctctactgggcctgccaagggtgcgtcctaaccggcgtctgggtcatagcccactagtgcggccaccacgccttcagcgactac

SEQ ID NO: 5049 - DNA, 318 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttggcaggcctctctactgggcctgccagggctgcgtcctaaccggcgtctgggtcatagcccacgagtgcggccaccacgccttcagcgactac

SEQ ID NO: 5050 - DNA, 346 bp, Artificial
  Mutation in BnaA.FAD2.a introduced by TALE nuclease pair BnFAD2_T01
caggatccatgggtgcaggtggaagaatgcaagtgtctcctccctccagctcccccgaaaccaaaaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgagtgcggccaccacgccttcagcgactac

SEQ ID NO: 5051 - DNA, 345 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccagggctgcgtcctaaccggcgtctgggtcatagcccacgagtgcggccaccacgccttcagcgactac

SEQ ID NO: 5052 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccagggctgcgtcctaacgggcctctgggtcatagcccacgagtgcggccaccacgccttcagcgactac

SEQ ID NO: 5053 - DNA, 348 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctggcctctctactgggcctgccaagggtgcgtcctaaccggcgtctgggtcatagcccacgagtgcggccaccacgccttcagcgactac

SEQ ID NO: 5054 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgctggcctctctactgggcctgccaagggtgcgtcctaaccggcgtctgggtcatagcccacgagtgcggccaccacgccttcagcgactac

SEQ ID NO: 5055 - DNA, 350 bp, Artificial
  Mutation in BnaA.FAD2.a introduced by TALE nuclease pair BnFAD2_T01
caggatccatgagtgcaggtggaagaatgcaagtctctcatccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaacgggcctctgggtcatagcccacgattgcggccaccacgccttcagcgactac

SEQ ID NO: 5056 - DNA, 349 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctttggcctctctactgggcctgccagggctgcgtcctaaccggcgtctgggtcatagcccacgagtgcggccaccacgccttcagcgactac

SEQ ID NO: 5057 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctggcctctctactgggcctgccaaggctgcgtcctaacgggcctctgggtcatagcccacgagtgcggccaccacgccttcagcgactac

SEQ ID NO: 5058 - DNA, 340 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatcccacgctccttctcctcttcgacatcatcatagcctcctgcttctactacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 5059 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaactctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactactggcctctctactgggcctgccaaggctgcggcctaacgggcctctgggtcatagcccacgagtgcggccaccacgccttcagcgactac

SEQ ID NO: 5060 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccaagggtgcgtcctaaccggcgtcttggtcatagcccacgagtgcggccaccacgccttcagcgactac

SEQ ID NO: 5061 - DNA, 449 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctccttcgccaggcccccggcttgaccccccagcaggtggtggccctcgccagcaatggcggtggcaagcaggcgctggagacggtccagcggctgttgccggtgctggcctctctactgggcctgccagggctgcgtcctaaccggcgtctgggtcatagcccacgagtgcggccaccacgccttcagcgactac

SEQ ID NO: 5062 - DNA, 480 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgacacaccctcctccccccccgcttcccacccgccgccccccctccctccccccccccccctcccccccccccccccccccccggagcggggggtgcccctccccagccacgagggcggcaacagccgcgggacccgcctggcctctctactgggcctgccagggctgcgtcctaaccggcgtctgggtcatagcccacgagtgcggccaccacgccttcagcgactac

SEQ ID NO: 5063 - DNA, 358 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcgggtctggcctctctactaggcctgccagggctgcgtcctaaccggcgtctgggtcatagcccacgagtgcggccaccacgccttcagcgactac

SEQ ID NO: 5064 - DNA, 340 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatcgcctcctgcttctactacgtcgccaccccttaattccctctcccccctcaccctctctcctcctttactgggcctgccagggctgcgtcctaaccggcgtctgggtcatagcccacgaatgcggccaccacgccttcagcgactac

SEQ ID NO: 5065 - DNA, 345 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccaaggctgcgtcctaacgggcctctgggtcatcgcccacgaatgcggccaccacgccttcagcgactac

SEQ ID NO: 5066 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcccctggcctctctactgggcctgccagggctgcgtcctaaccggcgtctgggtcatagcccacgagtgcggccaccacgccttcagcgactac

SEQ ID NO: 5067 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctgcctctctactgggcctgccagggctgcgtcctaaccggcgtctgggccatagcccacgagtgcggccaccacgccttcagcgactac

SEQ ID NO: 5068 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctgcctctctactgggcctgccagggctgcgtcctaaccggcgtctgggtcatagcccacgagtgcggccaccacgccttcagcgactac

SEQ ID NO: 5069 - DNA, 323 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgcctcctcttacttccctcgagccacccactgggcctgccaagagtgcgtcctaaccggcgtctgggtcatagcccacgagtgcggccaccacgccttcagcgactac

SEQ ID NO: 5070 - DNA, 347 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttccctctctgctgggcctgccagggctgcgtcctaaccggcgtctgggtcatagcccacgagtgcggccaccacgccttcagcgactac

SEQ ID NO: 5071 - DNA, 338 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccccctctactgggcctgccagggctgcgtcctaaccggcgtctgggtcatagcccacgagtgcggccaccacgccttcagcgactac

SEQ ID NO: 5072 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccagggctgcgtcctaaccggcgtctgggtcatagcccacgagtgcggccaccacgccttcagcgactac

SEQ ID NO: 5073 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 5074 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatggcctcctgcttctactacgtcgccaccacttacttccctctcctccctcaccctctctcctactctcctctctactgggcctgccaagggtgcgtcctaaccggcgtctgggtcatagcccacgagtgcggccaccacgccttcagcgactac

SEQ ID NO: 5075 - DNA, 340 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccactctactgggccagccagggctgcgtcctaaccggcgtatgggtcatagcccacgagtgcggccaccacgccttcagcgactac

SEQ ID NO: 5076 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcgaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgagtgcggccaccacgccttcagcgactac

SEQ ID NO: 5077 - DNA, 349 bp, Artificial
  Mutation in BnaA.FAD2.a introduced by TALE nuclease pair BnFAD2_T01
caggatccatgggtgcagggggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 5078 - DNA, 433 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcggctgttgccggtgctgtgccaggcccacggcttgaccccccagcgggtggtggccatcgccagcaatggcggtggcaacagccgctggaggcctggcctctctactgggcctgccagggctgcgtcctaaccggcgtctgggtcatagcccacgagtgcggccaccacgccttcagcgactac

SEQ ID NO: 5079 - DNA, 356 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaattccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccagggctgcgtcctaaccggcgtctgggtcatagcccacgagtgcggccaccacgccttcagcgactac

SEQ ID NO: 5080 - DNA, 430 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccgtatgtacggccagcaacgccggttcgagatggcgctcgatgacgccaacgatggccaccacctgctccggggtcaagccagttggcctctctactgggcctgccagggctgcgtcctaaccggcgtctgggtcatagcccacgagtgcggccaccacgccttcagcgactac

SEQ ID NO: 5081 - DNA, 346 bp, Artificial
  Mutation in BnaA.FAD2.a introduced by TALE nuclease pair BnFAD2_T01
caggatcatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccagggctgcgtcctaaccggcgtctgggtcatagcccacgagtgcggccaccacgccttcagcgactac

SEQ ID NO: 5082 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccacccttcactgtcggagaactcaagaaagcaatcccaccgcactgtttcaaacgctccatccctcgctctttctcctacctcatctgggacatcatcatatcctcctgcttctactacgtccccaccacttacttccctctcctccctcaccctctctcctcccccggcccctctactgggcctgccaaggctgcgtcctaaccggcctctgggtcatagcccacgagtgcggccaccacgccttcagcgactac

SEQ ID NO: 5083 - DNA, 329 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcacccactctgggcctgccagggctgcgtcctaaccggcgtctgggtcatagcccacgagtgcggccaccacgccttcagcgactac

SEQ ID NO: 5084 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgagcctgccagggctgcgtcctaaccggcgtctgggtcatagcccacgagtgcggccaccacgccttcagcgactac

SEQ ID NO: 5085 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgtgtcatagcccacgagtgcggccaccacgccttcagcgactac

SEQ ID NO: 5086 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctctcctacttctggcctctctactgggcctgccagggctgcgtcctaaccggcgtctgggtcatagcccacgagtgcggccaccacgccttcagcgactac

SEQ ID NO: 5087 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctccccccccctctctcctacttctggcctctctactgggcctgccagggctgcgtcctaaccggcgtctgggtcatagcccacgagtgcggccaccacgccttcagcgactac

SEQ ID NO: 5088 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccgcgagtgcggccaccacgccttcagcgactac

SEQ ID NO: 5089 - DNA, 354 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctggcctctctactgggcctgccaaggctgcgtcctaacgggcctctgggtcatcgcccacgaatgcggccaccacgccttcagcgactac

SEQ ID NO: 5090 - DNA, 342 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctctctactgggcctgccagggctgcgtcctaaccggcgtctgggtcatagcccacgagtgcggccaccacgccttcagcgactac

SEQ ID NO: 5091 - DNA, 332 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccaaggctgcgtcctaacgggcctctgggtcatcgcccacgagtgcggccaccacgccttcagcgactac

SEQ ID NO: 5092 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgagtgcggccaccacgccttcagcgactac

SEQ ID NO: 5093 - DNA, 339 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctactgggcctgccagggctgcgtcctaaccggcgtctgggtcatagcccacgagtgcggccaccacgccttcagcgactac

SEQ ID NO: 5094 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctatttctcctacctcatctgggacatcatcatagcctcctgcttctactacgtcgccaccacttacttccctctcctccctcaccctctctcctatggcctctctactgggcctgccaagggtgcgtcctaaccggcgtctgggtcatagcccacgagtgcggccaccacgccttcagcgactac

SEQ ID NO: 5095 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctaggcctctctactgggcctgccaagggtgcgtcctaaccggcgtctgggtcatagcccacgagtgcggccaccacgccttcagcgactac

SEQ ID NO: 5096 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccgcctggcctctctactgggcctaccaagggtgcgtcctaaccggcgtctgggtcatagcccacgagtgcggccaccacgccttcagcgactac

SEQ ID NO: 5097 - DNA, 318 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccccactgtttcaaacgctcgatccctcgctctttctcctacctcatctgggacatcatcatagcctcctgcttctactacgtcgccaccacttggcaggcctctctactgggcctgccagggctgcgtcctaaccggcgtctgggtcatagcccacgagtgcggccaccacgccttcagcgactac

SEQ ID NO: 5098 - DNA, 386 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcccccccctgctggggggtcaagccgtgtgcctggcacagtctctactgggcctgccagggctgcgtcctaacgggcctctgggtcatcgcccacgaatgcggccaccacgccttcagcgactac

SEQ ID NO: 5099 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctctactgggcctgccaaggctgcgtcctaacgggcctctgggtcatagcccacgagtgcggccaccacgccttcagcgactac

SEQ ID NO: 5100 - DNA, 341 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctactgggcctgccagggctgcgtcctaaccggcgtctgggtcatagcccacgagtgcggccaccacgccttcagcgactac

SEQ ID NO: 5101 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactggttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 5102 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctccatccctcgctctttctcctacctcatctgggacatcatcatagcctcctgcttctactacgtcgccaccacttacttccctctcctccctcaccctctctcctacctggcctctctactgggcctgccaagggtgcgtcctgaccggcgtctgggtcataggccacgagtgcggccaccacgccttcagcaactac

SEQ ID NO: 5103 - DNA, 343 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctctggcctctctactgggcctgccagggctgcgtcctaaccggcgtctgggtcatagcccacgagtgcggccaccacgccttcagcgactac

SEQ ID NO: 5104 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctcgcctctctactgggcctgccagggctgcgtcctaaccggcgtctgggtcatagcccacgagtgcggccaccacgccttcagcgactgc

SEQ ID NO: 5105 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcgcctgggcctgccagggctgcgtcctaaccggcgtctgggtcatagcccacgagtgcggccaccacgccttcagcgactac

SEQ ID NO: 5106 - DNA, 347 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttgcctctctactgggcctgccagggctgcgtcctaaccggcgtctgggtcatagcccacgagtgcggccaccacgccttcagcgactac

SEQ ID NO: 5107 - DNA, 340 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttactgggcctgccagggctgcgtcctaaccggcgtctgggtcatagcccacaagtgcggccaccacgccttcagcgactac

SEQ ID NO: 5108 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatcctctctactgggcctgccggggctgcgtcctaaccggcgtctgggtcatagcccacgagtgcggccaccacgccttcagcgactac

SEQ ID NO: 5109 - DNA, 343 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttcccgcccctccctcaccctctctcctatctctctactgggcctgccaaggctgcgtcctaacgggcctctgggtcatagcccacgagtgcggccaccacgccttcagcgactac

SEQ ID NO: 5110 - DNA, 312 bp, Artificial
  Mutation in BnaA.FAD2.a introduced by TALE nuclease pair BnFAD2_T01
caggatccatgggtgcaggtggaagaatgcaagtgtctcctccctcccaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctgtgcgtcctaaccggcgtctgggtcatagcccacgagtgcggccaccacgccttcagcgactac

SEQ ID NO: 5111 - DNA, 349 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctctctactgggcctgccagggctgcgtcctaaccggcgtctgggtcatagcccacgagtgcggccaccacgccttcagcgactac

SEQ ID NO: 5112 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatcctctctacggggcctgccagggctgcgtcctaaccggcgtctgggtcatagcccacgagtgcggccaccacgccttcagcgactac

SEQ ID NO: 5113 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaaggttgcgtcctaaccggcgtctgggtcatagcccacgagtgcggccaccacgccttcagcgactac

SEQ ID NO: 5114 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccagggctgcgtcctaaccggcgtctgggtcatagcccacgagtgcggccaccacgccttcagcgactac

SEQ ID NO: 5115 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacctcgcctctctactgggcctgccagggctgcgtcctaaccggcgtctgggtcatagcccacgagtgcggccaccacgccttcagcgactac

SEQ ID NO: 5116 - DNA, 347 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctctttctcctacctcatctgggacatcatcatagcctcctgcttctactacgtcgccaccacttacttccctctcctccctcaccctctctcctactcgcctctctactgggcctgccagggctgcgtcctaacgggcctctgggtcatagcccacgagtgcggccaccacgccttcagcgactac

SEQ ID NO: 5117 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccagggctgcgtcctaacgggcctctgggtcatagcccacgagtgcggccaccacgccttcagcgactac

SEQ ID NO: 5118 - DNA, 347 bp, Artificial
  Mutation in BnaA.FAD2.a introduced by TALE nuclease pair BnFAD2_T01
caggatccatgggtgcaggtggaagaatgcaagtgtctcccccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcgcctctctactgggcctgccagggctgcgtcctaaccggcgtctgggtcatagcccacgagtgcggccaccacgccttcagcgactac

SEQ ID NO: 5119 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccccctcctccctcaccctctctcctacttggcctctctactgggcctgccaagggtgcgtcctaaccggcgtctgggtcatagcccacgagtgcggccaccacgccttcagcgactac

SEQ ID NO: 5120 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctatttctcctacctcatctgggacatcatcatagcctcctgcttctactacgtcgccaccactacttccctctcctccctcaccctctctcctacttcgctggcctctctactgggcctgccagggctgcgtcctaaccggcgtctgggtcatagcccacgagtgcggccaccacgccttcagcgactac

SEQ ID NO: 5121 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgtgacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtcggggtcatagcccacgagtgcggccaccacgccttcagcgactac

SEQ ID NO: 5122 - DNA, 357 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccggtttgcgtattgccggtgcctggcctctctactgggcctgccaagggtgcgtcctaaccggcgtctgggtcatagcccacgagtgtggccaccacgccttcagcgactac

SEQ ID NO: 5123 - DNA, 357 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccggtttgcgtattcccggtgcctggcctctctactgggcctgccaagggtgcgtcctaaccggcgtctgggtcatagcccacgagtgtggccaccacgccttcagcgactac

SEQ ID NO: 5124 - DNA, 430 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttaggtacggccagcaacgtcggttcgagatggcgctcgatgacgccaacgatggccaccacctgctccggggtcaagccagttggcctctctactgggcctgccagggctgcgtcctaaccggcgtctgggtcatagcccacgagtgcggccaccacgccttcagcgactac

SEQ ID NO: 5125 - DNA, 347 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcccctctactgggcctgccaaggctgcgtcctaacgggcctctgggtcatagcccacgagtgcggccaccacgccttcagcgactac

SEQ ID NO: 5126 - DNA, 386 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttggccaccacctgctggggggtcaagccgtgggcctggcacagtctctactgggcctgccagggctgcgtcctaaccggcgtctgggtcatagcccacgagtgcggccaccacgccttcagcgactac

SEQ ID NO: 5127 - DNA, 348 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccatcagcgactac

SEQ ID NO: 5128 - DNA, 476 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctcccctccctcaccctctcccttccccctcccccagctgctccctccccctagccgcctccttctactaccccgcccccactttctcccctcccctccctcaccccctctcctccttggccaccacctgctgggggctcaagccgtggccctggcacagtctctactgggcctgccagggctgcgtcctaaccggcgtctgggtcatagcccacgagtgcggccaccacgccttcagcgactac

SEQ ID NO: 5129 - DNA, 386 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccaccccctgctggggggtcaagccgtgggcctggcacagtctctactgggcctgccagggctgcgtcctaaccggcgtctgggtcatagcccacgagtgcggccaccacgccttcagcgactac

SEQ ID NO: 5130 - DNA, 338 bp, Artificial
  Mutation in BnaA.FAD2.a introduced by TALE nuclease pair BnFAD2_T01
caggatccatgggtgcaggtggaagaatacaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctctctactgggcctgccagggctgcgtcctaaccggcgtctgggtcatagcccacgagtgcggccaccacgccttcagcgactac

SEQ ID NO: 5131 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctccgcccctggcctctctactgggcctgccaagggtgcgtcctaaccggcgtctgggtcatagcccacgagtgcggccaccacgccttcagcgactac

SEQ ID NO: 5132 - DNA, 349 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 5133 - DNA, 471 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcttttttacaatgccaactttgtacaaaaaagcaggcttaggtacctcgcgaatgcatctagatccaatgatcatgagcggagaatgggcctggcacagcaccggcaacagccgctggacctggcctctctactgggcctgccagggctgcgtcctaaccggcgtctgggtcatagcccacgagtgcggccaccacgccttcagcgactac

SEQ ID NO: 5134 - DNA, 356 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccagggctgcgtcctaaccggcgtctgggtcatagcccacgagtgcggccaccacgccttcagcgactac

SEQ ID NO: 5135 - DNA, 334 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgatacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccagggctgcgtcctaaccggcgtctgggtcatagcccacgagtgcggccaccacgccttcagcgactac

SEQ ID NO: 5136 - DNA, 349 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 5137 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtcttaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 5138 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctcctcccccggcctctccacctggcctgccagggctgcgtcctaaccggcgtctgggtcatagcccacgagtgcggccaccacgccttcagcgactac

SEQ ID NO: 5139 - DNA, 332 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctgggcctgccagggctgcgtcctaaccggcgtctgggtcatagcccacgagtgcggccaccacgccttcagcgactac

SEQ ID NO: 5140 - DNA, 347 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctactggcctctctactgggcctgccagggctgcgtcctaaccggcgtctgggtcatagcccacgagtgcggccaccacgccttcagcgactac

SEQ ID NO: 5141 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatcctcgctctttctcctacctcatctgggacatcatcatagcctcctgcttctactacgtcgccaccacttacttccctctcctccctcaccctctctcctacttcgccgcctggcctctctactgggcctgccagggctgcgtcctaaccggcgtctgggtcatagcccacgagtgcggccaccacgccttcagcgactac

SEQ ID NO: 5142 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggccctctactgggcctgccaaggctgcgtcctaacgggcctctgggtcatcgcccacgagtgcggccaccacgccttcagcgactac

SEQ ID NO: 5143 - DNA, 421 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctgccaggcatcaaataaaacgaaaggctcagtctcggtcgttcggctgcggcgagcggtatcagctcactcaaagcctggcctctctactgggcctgccaaggctgcgtcctaacgggcctctgggtcatagcccacgagtgcggccaccacgccttcagcgactac

SEQ ID NO: 5144 - DNA, 345 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctccccttggcctctctactgggcctgccagggctgcgtcctaaccggcgtctgggtcatagcccacgagtgcggccaccacgccttcagcgactac

SEQ ID NO: 5145 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggcctgccagggctgcgtcctaaccggcgtctgggtcatagcccacgagtgcggccaccacgccttcagcgactac

SEQ ID NO: 5146 - DNA, 424 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctactccctcaccctctctcctccttctccagcgcctgcttgccgccatcgtggctggcgatggccaccacctgttggggggtcaagccgtgggcctggcatggcctctctactgggcctgccagggctgcgtcctaaccggcgtctgggtcatagcccacgagtgcggccaccacgccttcagcgactac

SEQ ID NO: 5147 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccatctctcctccgctggcctctctactgggcctgccagggctgcgtcctaaccggcgtctgggtcatagcccacgagtgcggccaccacgccttcagcgactac

SEQ ID NO: 5148 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacctcgctggcccctctactgggcctgccaaggctgcgtcctaacgggcctctgggtcatcgcccacgaatgcggccaccacgccttcagcgactac

SEQ ID NO: 5149 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggcctgccaagggtgcgtcctaaccggcgtcttggtcatagcccacgagtgcggccaccacgccttcagcgactac

SEQ ID NO: 5150 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccaagggtgcgtcctaacgggcctctgggtcatagcccacgagtgcggccaccacgccttcagcgactac

SEQ ID NO: 5151 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcctctctactgggcctgccaagggtgcgtcctaaccggcgtctgggtcatagcccacgagtgcggccaccacgccttcagcgactac

SEQ ID NO: 5152 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcacgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgctggcctctctactgggcctgccaagggtgcgtcctaaccggcgtctgggtcatagcccacgagtgcggccaccacgccttcagcgactac

SEQ ID NO: 5153 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatcctccctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 5154 - DNA, 352 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccacttcgcctggcctctctactgggcctgccagggctgcgtcctaaccggcgtctgggtcatagcccacgagtgcggccaccacgccttcagcgactac

SEQ ID NO: 5155 - DNA, 357 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcgcgcctggcctctctactgggcctgccagggctgcgtcctaaccggcgtctgggtcatagtccacgagtgcggccaccacgccttcagcgactac

SEQ ID NO: 5156 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtctggcctctctactgggcctgccaagggtgcgtcctaaccggcgtctgggtcatagcccacgagtgcggccaccacgccttcagcgactac

SEQ ID NO: 5157 - DNA, 352 bp, Artificial
  Mutation in BnaA.FAD2.a introduced by TALE nuclease pair BnFAD2_T01
caggatccatgggtgcaggttgaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccggcctctctactgggcctgccagggctgcgtcctaaccggcgtctgggtcatagcccacgagtgcggccaccacgccttcagcgactac

SEQ ID NO: 5158 - DNA, 335 bp, Artificial
  Mutation in BnaA.FAD2.a introduced by TALE nuclease pair BnFAD2_T01
caggatccatgggtgcaggtggaagaatgcaagtgtctcctccctccagctcccccgaaaccaaaaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccagggctgcgtcctaaccggcgtctgggtcatagcccacgagtgcggccaccacgccttcagcgactac

SEQ ID NO: 5159 - DNA, 340 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgcaagggctgcgtcctaaccggcgtctgggtcatagcccacgagtgcggccaccacgccttcagcgactac

SEQ ID NO: 5160 - DNA, 325 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgcttcaaacgctccatccctcgctctttctcctacctcatctgggacatcatcatagcctcctgcttctactacgtcgccaccacttacttccctctcctccctcaccctctctcctacttggctgcgtcctaaccggcgtctgggtcatagcccacgagtgcggccaccacgccttcagcgactac

SEQ ID NO: 5161 - DNA, 450 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctctctcctacctcatctgggacatcatcatagcctcctgcttctactacgtctccaccacttacttcccactcctccctcaccctctctcctacttcgaaaacggcttgtcccgcgtcatcggcgggggtcataacgtggctcccttacggcagtgcatgcatggcgcaatgcactgacgggtgccccgctcacctttggcctctctactgggcctgccagggctgcgtcctaaccggcgtctgggtcatagcccacgagtgcggccaccacgccttcagcgactac

SEQ ID NO: 5162 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgtgacatcatcatagcctcctgcttctactacgtcgccaccacttacttccctctcctccctcaccctctctcctacttgcctctctactgggcctgccagggctgcgtcctaaccggcgtctgggtcatagcccacgagtgcggccaccacgccttcagcgactac

SEQ ID NO: 5163 - DNA, 450 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctctctcctacctcatctgggacatcatcatagcctcctgcttctactacgtcgccaccacttacttccctctcctccctcaccctctctcctacttcgaaaacggcttgtcccgcgtcatcggcgggggtcataacgtgactcccttaaggcagtgcatgcatggcgcaatgcactgacgggtgccccgctcaactttggcctctctactgggcctgccagggctgcgtcctaaccggcgtctgggtcatagcccacgagtgcggccaccacgccttcagcgactac

SEQ ID NO: 5164 - DNA, 408 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctccgagccgaagtttccaaaaggtcgttgatcaaagctcgccgcgttgtttcatcaagccttggcctctctactgggcctgccaaggctgcgtcctaacgggcctctgggtcatagcccacgagtgcggccaccacgccttcagcgactac

SEQ ID NO: 5165 - DNA, 387 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcctagcctcctgcttctacttcgtcgccaccacttacttccctctcctccctcaccctctctccttcttcgccgccatcgtggctggcgatggccaccacctgctcctggcctctctactgggcctgccaaggctgcgtcctaaccggcgtctgggtcatagcccacgagtgcggccaccacgccttcagcgactac

SEQ ID NO: 5166 - DNA, 339 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctctcctacttactgggcctgccagggctgcgtcctaaccggcgtctgggtcatagcccacgagtgcggccaccacgccttcagcgactac

SEQ ID NO: 5167 - DNA, 450 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgaaaacggcttgtcccgcgtcatcggcgggggtcataacgtgcctcccttaaggcagtgcatgcatggcgcaatgcactgacgggtgccccgctcaactttggcctctctactgggcctgccagggctgcgtcctaacgggcctctgggtcatagcccacgagtgcggccaccacgccttcagcgactac

SEQ ID NO: 5168 - DNA, 300 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatatgggacatcatcatagcctcctgcttctactacgtctctctactgggcctgccaagggtgcgtcctaaccggcgtctgggtcatagcccacgagtgcggccaccacgccttcagcgactac

SEQ ID NO: 5169 - DNA, 385 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccccgtgggcctggcacagcaccggcaacagccgctggaccgtctccagcgcctgcctggcctctctactgtgcctgccagggctgcgtcctaaccggcgtctgggtcatagcccacgagtgcggccaccacgccttcagcgactac

SEQ ID NO: 5170 - DNA, 354 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttcgcctggcctctctactgggcctgccagggctgcgtcctaaccggcgtctgggtcatagcccacgagtgcggccaccacgccttcagcgactac

SEQ ID NO: 5171 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctctcctacggcctctctactgggcctgccaagggtgcgtcctaaccggcgtctgggtcatagcccacgagtgcggccaccacgccttcagcgactac

SEQ ID NO: 5172 - DNA, 345 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggcctgccaagggtgcgtcctaaccggcgtctgggtcatagcccacgagtgcggccaccacgccttcagcgactac

SEQ ID NO: 5173 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 5174 - DNA, 342 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctaccgggcctgccagggctgcgtcctaaccggcgtctgggtcatagcccacgagtgcggccaccacgccttcagcgactac

SEQ ID NO: 5175 - DNA, 380 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccacagtggcccggcgcccgcgctctggaggcctgcctctctactgggcctgccaagggtgcgtcctaaccggcgtctgggtcatagcccacgagtgcggccaccacgccttcagcgactac

SEQ ID NO: 5176 - DNA, 349 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatccgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 5177 - DNA, 324 bp, Artificial
  Mutation in BnaA.FAD2.a introduced by TALE nuclease pair BnFAD2_T01
catgatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcttgccaagggtgcgtcctaaccggcgtctgggtcatagcccacgagtgcggccaccacgccttcagcgactac

SEQ ID NO: 5178 - DNA, 337 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtgggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctactgggcctgccaagggtgcgtcctaaccggcgtctgggtcatagcccacgagtgcggccaccacgccttcagcgactac

SEQ ID NO: 5179 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgttccctcgctctttctcctacctcatctgggacatcatcatagcctcctgcttctactacgtcgccaccacttacttccctctcctccctcaccctctctcctccggcctctctactgggcctgccaaggctgcgtcctaacgggcctctgggtcatagcccacgagtgcggccaccacgccttcagcgactac

SEQ ID NO: 5180 - DNA, 343 bp, Artificial
  Mutation in BnaA.FAD2.a introduced by TALE nuclease pair BnFAD2_T01
caggatccatgggtgcaggtggaataatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctaactctctactgggcctgccaagggtgcgtcctaaccggcgtctgggtcatagcccacgagtgcggccaccacgccttcagcgactac

SEQ ID NO: 5181 - DNA, 343 bp, Artificial
  Mutation in BnaA.FAD2.a introduced by TALE nuclease pair BnFAD2_T01
caggatccatgggtgcaggtggaataatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaactctctactgggcctgccaagggtgcgtcctaaccggcgtctgggtcatagcccacgagtgcggccaccacgccttcagcgactac

SEQ ID NO: 5182 - DNA, 446 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcagcggtggtttttttgtttgcaagcagcagattacgcgcagaaaaaaaggatctcaggtggtggccatcgccagcaatggcggtggcaagcaggcgctgcctctctactgggcctgccaagggtgcgtcctaaccggcgtctgggtcatagcccacgagtgcggccaccacgccttcagcgactac

SEQ ID NO: 5183 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctggcccctctactgggcctgccaaggctgcgtcctaacgggcctctgggtcatcgcccacgaatgcggccaccacgccttcagcgactac

SEQ ID NO: 5184 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctatggcctctctactgggcctgccaagggtgcgtcctaaccggcgtctgggtcatagcccacgagtgcggccaccacgccttcagcgactac

SEQ ID NO: 5185 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgctac

SEQ ID NO: 5186 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctttcctggcctctctactgggcctgccagggctgcgtcctaacgggcctctgggtcatcgcccacgaatgcggccaccacgccttcagcgactac

SEQ ID NO: 5187 - DNA, 387 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgccgccatcgtggctggcgatggccaccacctgctcctggcctctctactgggcctgccaagggtgcgtcctaaccggcgtctgggtcatagcccacgagtgcggccaccacgccttcagcgactac

SEQ ID NO: 5188 - DNA, 356 bp, Artificial
  Mutation in BnaA.FAD2.a introduced by TALE nuclease pair BnFAD2_T01
caggatccatgggtgcaggtggaagaatgcaagtgtctcctccctccaagaagtccgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcgcgcctggcctctctactgggcctgccagggctgcgtcctaaccggcgtctgggtcatagcccacgagtgcggccaccacgccttcagcgctac

SEQ ID NO: 5189 - DNA, 341 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctccctcccccctctactgggcctgccagggctgcgtcctaaccggcgtctgggtcatagcccacgaatgtggccaccacgccttcagcgactac

SEQ ID NO: 5190 - DNA, 341 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcgctcctctctctactgggcctgccagggctgcgtcctaaccggcgtctgggtcatcgcccacgaatgtggccaccacgccttcagcgactac

SEQ ID NO: 5191 - DNA, 347 bp, Artificial
  Mutation in BnaA.FAD2.a introduced by TALE nuclease pair BnFAD2_T01
caggatccatgggtgcaggtggaagaatgcaggtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccagggctgcgtcctaaccggcgtctgggtcatagcccacgagtgcggccaccacgccttcagcgactac

SEQ ID NO: 5192 - DNA, 351 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccagggctgcgtcctaaccggcgtctgggtcatagcccacgagtgcggccaccacgccttcagcgactac

SEQ ID NO: 5193 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcccccggcctctctactgggcctgccagggctgcgtcctaacgggcctctgggtcatagcccacgaatgcggccaccacgccttcagcgactac

SEQ ID NO: 5194 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaaactcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaaggctgcgtcctaacgggcctctgggtcatagcccacgagtgcggccaccacgccttcagcgactac

SEQ ID NO: 5195 - DNA, 349 bp, Artificial
  Mutation in BnaA.FAD2.a introduced by TALE nuclease pair BnFAD2_T01
caggatccatgggtgcaggtggaagaatgcaagtgtctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatggcccacgagtgcggccaccacgccttcagcgactac

SEQ ID NO: 5196 - DNA, 339 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctactgggcctgccagggctgcgtcctaaccggcgtctgggtcatagcccgcgagtgcggccaccacgccttcagcgactac

SEQ ID NO: 5197 - DNA, 318 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttggcaggcctctctactgggcctgcaagggctgcgtcctaaccggcgtctgggtcatagcccacgagtgcggccaccacgccttcagcgactac

SEQ ID NO: 5198 - DNA, 431 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccacccttcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctcctgttgccggtgctgtgccaggcgctcggtcgtccggctgcggcgagcggtatcagctcactcaaaggcggtaatacggttatcctggcctctctactgggcctgccagggctgcgtcctaaccggcgtctgtgtcatagcccacgagtgcggccaccacgccttcagcgactac

SEQ ID NO: 5199 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgcctccacttacttccctctcctccctcaccctctctcctgcctctctactgggcctgccagggctgcgtcctaaccggcgtctgggtcatagcccacgagtgcggccaccacgccttcagcgactac

SEQ ID NO: 5200 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccccactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 5201 - DNA, 398 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgcaaactactcaagattgcaaaacgtggcggcgggaccgcagtggaggcagtgcatgcgcctctctactgggcctgccaagggtgcgtcctaaccggcgtctgggtcatagcccacgagtgcggccaccacgccttcagcgactac

SEQ ID NO: 5202 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaaggctgcgtcctaacgggcctctgggtcatcgcccacgaatgcggccaccacgccttcagcgactac

SEQ ID NO: 5203 - DNA, 277 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctccctcaccctctctcctacttcgcgccttcagcgactac

SEQ ID NO: 5204 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcccctctactgggcctgccaaggctgcgtcctaacgggcctctgggtcatcgcccacgaatgcggccaccacgccttcagcgactac

SEQ ID NO: 5205 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaaacgcgtcccctgcgagacaccaccattcactctcggagacctcaagaaagcaatcccaccgcactgtttcaaacgctcgatccctcgctctttctcctaccttatctgggacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgccttcagcgactac

SEQ ID NO: 5206 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccagggctgcgtcctaaccggcgtctgggtcatagcccacgagtgcggccaccacgccttcagcgactac

SEQ ID NO: 5207 - DNA, 346 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgagtgcggccaccacgccttcagcgactac

SEQ ID NO: 5208 - DNA, 343 bp, Artificial
  Mutation in BnaA.FAD2.a introduced by TALE nuclease pair BnFAD2_T01
caggatccatgggtgcaggtggaagaatgcaagtgtctcctccctcaagaaggctgaaaccgacaccatcaagcgcgtaccctgcgagaccccgcccttcactgtcggagaactcaagaaagccatcccaccgcactgtttcaaacgctcgatcccccgctctttctcctacctcatctgggacatcctcattgcctcctgcttctactacgtcgccaccacttacttccctctcccccctccccctctcacctatcctctctactgggcctgccagggctgcgtcctaaccggcgtctgggtcatagcccacgagtgcggccaccacgccttcagcgactac

SEQ ID NO: 5209 - DNA, 334 bp, Artificial
  Mutation in BnaA.FAD2.a introduced by TALE nuclease pair BnFAD2_T01
caggatccattggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccagggctgcgtcctaaccggcgtctgggtcatagcccacgagtgcggccaccacgccttcagcgactac

SEQ ID NO: 5210 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccaacttcgcctctctactgggcctgccaagggtgcgtcctaaccggcgtctgggtcatagcccacgagtgcggccaccacgccttcagcgactac

SEQ ID NO: 5211 - DNA, 332 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccagggctgcgtcctaaccggcgtctgggtcatagcccacgagtgcggccaccacgccttcagcgactac

SEQ ID NO: 5212 - DNA, 349 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaacgggcgtctgggtcatagcccacgagtgcggccaccacgccttcagcgactac

SEQ ID NO: 5213 - DNA, 345 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccagggctgcgtcctaaccggcgtctgggtcatagcccacgagtgcggccaccacgccttcagcgactac

SEQ ID NO: 5214 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctcctggcctctctcctgggcctgccaaggttgcgtcctaacgggcctctgggtcatagcccacgagtgcggccaccacgccttcagcgactac

SEQ ID NO: 5215 - DNA, 401 bp, Artificial
  Mutation in BnaA.FAD2.a introduced by TALE nuclease pair BnFAD2_T01
caggatccatgggtgcaggtggaagaatgcaagtgcctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgccataaactgccaggcatcaaactaagcagaaggccatccgtccataggctggcctctctactgggcctgccaatggtgcgtcctaaccggcgtctgggtcatagcccacgagtgcggccaccacgccttcagcgactac

SEQ ID NO: 5216 - DNA, 349 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctttcctggcctctctactgggcctgccagggctgcgtcctaaccggcgtctgggtcatagcccacgagtgcggccaccacgccttcagcgactac

SEQ ID NO: 5217 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgttggcctctctactgggcctgccagggctgcgtcctaaccggcgtctgggtcatagcccacgagtgcggccaccacgccttcagcgactac

SEQ ID NO: 5218 - DNA, 346 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgagtgcggccaccacgccttcagcaactac

SEQ ID NO: 5219 - DNA, 415 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcgctggagacgacggccaccacctgctggggggtcaagttgagcggggcacccgtcagtgcatgcatggcctctctactgggcctgccagggctgcgtcctaaccggcgtctgggtcatagcccacgagtgcggccaccacgccttcagcgactac

SEQ ID NO: 5220 - DNA, 337 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctactgggcctgccagggctgcgtcctaaccggcgtctgggtcatagcccacgagtgcggccaccacgccttcagcgactac

SEQ ID NO: 5221 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccagggctgcgtcctaaccggcgtcggggtcatagcccacgagtgcggccaccgcgccatcagcgactac

SEQ ID NO: 5222 - DNA, 348 bp, Artificial
  Mutation in BnaA.FAD2.a introduced by TALE nuclease pair BnFAD2_T01
caggatccatgggtgcaggtggaagaatgcaagtgactcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 5223 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccaccattcactgtcggagaactcaagaaagcaatcccaccgcactgtttcaaacgctcgatccctcgctctttctcctacctcatctggtacatcatcctagcctcctgcttctactacgtcgccaccacttacttccctctcctccctcaccctctctcctacgcctggcctctctactgggcctgccagggctgcgtcctaaccggcctctgggtcatagcccacgagtgcggccaccacgccttcagcgactac

SEQ ID NO: 5224 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctcgcctggcctctctactgggcctgccagggctgcgtcctaacgggcctctgggtcatcgcccacgaatgcggccaccacgccttcagcgactac

SEQ ID NO: 5225 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactat

SEQ ID NO: 5226 - DNA, 350 bp, Artificial
  Mutation in BnaA.FAD2.a introduced by TALE nuclease pair BnFAD2_T01
caggatccatgggtgcaggttgaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcaccatagcctcctgcttctactacgtcgccaccacttacttccctctcctccctcaccctctctcctactattggcctctctactgggcctgccagggctgcgtcctaaccggcgtctgggtcatagcccacgagtgcggccaccacgccttcagcgactac

SEQ ID NO: 5227 - DNA, 355 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccagggctgcgtcctaaccggcgtctgggacatagcccacgagtgcggccaccacgccttcagcgactac

SEQ ID NO: 5228 - DNA, 345 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgcctctctactgggcctgccagggctgcgtcctaaccggcgtctgggtcatagcccacgagtgcggccaccacgccttcagcgactac

SEQ ID NO: 5229 - DNA, 346 bp, Artificial
  Mutation in BnaA.FAD2.a introduced by TALE nuclease pair BnFAD2_T01
caggatccatgggtgcaggtggaagaatgcaagtgtctcctccctcccaaaagactgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacggcctctctactgggcctgccagggctgcgtcctaaccggcgtcttggtcatagcgctcgagtgcggccactgcgccgtcagcgactac

SEQ ID NO: 5230 - DNA, 349 bp, Artificial
  Mutation in BnaA.FAD2.a introduced by TALE nuclease pair BnFAD2_T01
caggatccatgggtgcaggtggaagaatgcaagtgtatcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctactttcgcctctctactgggcctgccagggctgcgtcctaaccggcgtctgggtcatagcccacgatttcggccaccacgccatcaacgactac

SEQ ID NO: 5231 - DNA, 338 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctctctactgggcctgccagggctgcgtcctaaccggcgtctgggtcatagcccacgagtgcggccaccacgccttcagcgactac

SEQ ID NO: 5232 - DNA, 357 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcgcgcctggcctctctactgggcctgccagggctgcgtcctaacgggcctctgggtcatcgcccacgagtgcggccaccacgccttcagcgactac

SEQ ID NO: 5233 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccttacccctctactgggcctgccaaggctgcgtcctaacgggcctctgggtcatcgcccacgaatgcggccaccacgccttcagcgactac

SEQ ID NO: 5234 - DNA, 344 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctggcctctctactgggcctgccagggctgcgtcctaaccggcgtctgggtcatagcccacgagtgcggccaccacgccttcagcgactac

SEQ ID NO: 5235 - DNA, 348 bp, Artificial
  Mutation in BnaA.FAD2.a introduced by TALE nuclease pair BnFAD2_T01
caggacccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 5236 - DNA, 348 bp, Artificial
  Mutation in BnaA.FAD2.a introduced by TALE nuclease pair BnFAD2_T01
caggatccatgggtgcaggtggaagaatgcaagtctctcctccctccagctcccccggaaccgacaccctcaaacgcgtcccctgcgagacaccaccattcactctcggagacctcaagaaagcaatcccacctcactgcttcaaacgctccatccctcgctctttctcctacctcatctgggacatcatcatagcctcctgcttctactacgtcaccaccacttacttccctctcctccctcaccctctctcctacctcgcctctctactgggcctgccagggctgcgtcctaaccggcgtctgggtcatagcccacgagtgcggccaccacgccttcagcgactac

SEQ ID NO: 5237 - DNA, 424 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgtgccaggcccacggcttgaccccggagcaggtggtggccatcgccagccacgatggcggcaagcaggcgctggactggcctctctactgggcctgccagggctgcgtcctaaccggcgtctgggtcatagcccacgagtgcggccaccacgccttcagcgactac

SEQ ID NO: 5238 - DNA, 344 bp, Artificial
  Mutation in BnaA.FAD2.a introduced by TALE nuclease pair BnFAD2_T01
caggatccatgggtgcagggggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctagcctctctactgggccggccaagggtgcgtcctaaccggcttctgggtcatagcccacgaatgcggccaccacgccttcagcgactac

SEQ ID NO: 5239 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttccctggcctctctactgggcctgccaagggtgcgtcctaaccggcgtctgggtcatagcccacgagtgcggccaccacgccttcagcgactac

SEQ ID NO: 5240 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctccttctcctacctcatctgggacatcatcatagcctcctgcttctactacgtcgccaccacttacttccctctcctccctcaccctctctcctaccctagcctctctactgggcctgccaagggtgcgtcctaaccggcgtctgggtcatagcccacgagtgcggccaccacgccttcagcgactac

SEQ ID NO: 5241 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttggcctctctactgggcctgccagggctgcgtcctaacgggcctctgggtcatagcccacgagtgcggccaccacgccttcagcgactac

SEQ ID NO: 5242 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcgccctctctcctacttgcctctctactgggcctgccagggctgcgtcctaaccggcgtctgggtcatagcccacgagtgcggccaccacgccttgagcgactac

SEQ ID NO: 5243 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcccacctcatctgggacatcatcatagcctcctgcttctactacgtcgccaccacttacttccctctcctccctcaccctctctcctaggcctctctactgggcctgccaagggtgcgtcctaacgggcctctgggtcatagcccacgagtgcggccaccacgccttcagcgactac

SEQ ID NO: 5244 - DNA, 352 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgccggcctctctactgggcctgtcagggctgcgtcctaaccggcgtctgggtcatagcccacgagtgcggccaccacgccttcagcgactac

SEQ ID NO: 5245 - DNA, 335 bp, Artificial
  Mutation in BnaA.FAD2.a introduced by TALE nuclease pair BnFAD2_T01
cgggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaccgctcgatccctcgctctttctcctacctcatctgggacatcatcatagcctcctgcttctactacgtcgccaccacttacttccctctcctccctcaccctctctcctactgggcctgccagggctgcgtcctaaccggcgtctgggtcatagcccacgagtgcggccaccacgccttcagcgactac

SEQ ID NO: 5246 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgttggcctctctactgggcctgccaagggtgcgtcctaaccggcgtctgggtcatagcccacgagtgcggccaccacgccttcagcgactac

SEQ ID NO: 5247 - DNA, 350 bp, Artificial
  Mutation in BnaA.FAD2.a introduced by TALE nuclease pair BnFAD2_T01
caggatccatgggtgcaggtggaagaatgcaagtgtctcctccctcccaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 5248 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgctggcctctctactgggcctgccagggcggcgtcctaaccggcgtctgggtcatagcccacgattgcggcgaccacgccatcagcgactac

SEQ ID NO: 5249 - DNA, 335 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccagggctgcgtccgaaccggcgtctgggtcatagcccacgagtgcggccaccacgccttcagcgactac

SEQ ID NO: 5250 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccatggcctctctactgggcctgccagggctgcgtcctaaccggcgtctgggtcatagcccacgagtgcggccaccgcgccttcagcgactac

SEQ ID NO: 5251 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaacctacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 5252 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgggcctctctactgggcctgccagggctgcgtcctaaccggcgtctgggtcatagcccacgagtgcggccaccacgccttcagcgactac

SEQ ID NO: 5253 - DNA, 408 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcactctttctcctacctcatctgggacatcatcatagcctcctgcttctactacgtcgccaccacttacttccctctcctccctcaccctctctcctacttcgagccgaagtttccaaaaggtcgttgatcaaagctcgccgcgttgtttcatcaagccttggcctctctactgggcctgccaagggtgcgtcctaaccggcgtctgggtcatagcccacgagtgcggccaccacgccttcagcgactac

SEQ ID NO: 5254 - DNA, 358 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcggcgggtctggcctctctactaggcctgccagggctgcgtcctaaccggcgtctgggtcatagcccacgagtgcggccaccacgccgtcagcgactac

SEQ ID NO: 5255 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgtcagggctgcgtcctaacgggcctctgggtcatagcccacgagtgcggccaccacgccttcagcgactac

SEQ ID NO: 5256 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctgcctctctactgtgcctgccagggctgcgtcctaaccgtcgtctgggtcatagcccacgagtgcggccaccacgccttcagcgactac

SEQ ID NO: 5257 - DNA, 334 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcacccactctctactgggccggccagggctgcgtcctaaccggcgtcggggtcatagcccacgagtgcggccaccgcgccttcagcgactac

SEQ ID NO: 5258 - DNA, 339 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgcttcaaacgctcgatccctcgctctttctcctacctcatctgggacatcatcatatcctcctgcttctactacgtccccaccacttacttccctctcctccctcaccctctcgcctctctactgggcctgccaagggtgcgtcctaacgggcctctgggtcatagcccacgagtgcggccaccacgccttcagcgactac

SEQ ID NO: 5259 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccacctcactgtttcaaacgctcgatccctcgctctttctcctacctcatctgggacatcatcatagcctcctgcttctactacgtcgccaccacttacttccctctcctccctcaccatctctcctaggcctctctactgggcctgccagggctgcgtcctaaccggcgtctgggtcatagcccacgagtgcggccaccacgccttcagcgactac

SEQ ID NO: 5260 - DNA, 300 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtctctctactgggcctgccaaggctgcgtcctaacgggcctctgggtcatagcccacgagtgcggccaccacgccttcagcgactac

SEQ ID NO: 5261 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcgaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgagtgcggccaccacgccttcagcgactac

SEQ ID NO: 5262 - DNA, 334 bp, Artificial
  Mutation in BnaA.FAD2.a introduced by TALE nuclease pair BnFAD2_T01
caggatccatgggtgcaggtggaagaatgcaagtctctcctccatccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccaaggctgcgtcctaacgggcctctgggtcatcgcccacgaatgcggccaccacgccttcagcgactac

SEQ ID NO: 5263 - DNA, 334 bp, Artificial
  Mutation in BnaA.FAD2.a introduced by TALE nuclease pair BnFAD2_T01
caggatccatgggtgcaggtggaagaatgcaagtctctcctccatccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccaaggctgcgtcctaacgggcctcggggtcatcgcccacgaatgcggccaccacgccttcagcgactac

SEQ ID NO: 5264 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactagcctctctactgggcctgccaagggtgtgtcctaaccggcgtctgggtcatagcccacgagtgcggcgaccgcgccatcagcgactac

SEQ ID NO: 5265 - DNA, 385 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccccgtgggcctggccccgcaccggcaacagccgctggaccgtctccagcgccggcctggcctctctactgggcctgccaagggtgcgtcctaaccggcgtctgggtcatagcccacgagtgcggccaccacgccttcagcgactac

SEQ ID NO: 5266 - DNA, 385 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccccgtgggcctggcccggcaccggcaccagccgctggaccgtctccagcgcctgcctggcctctctactgggcctgccaagggtgcgtcctaaccggcgtctgggtcatagcccacgagtgcggccaccacgccttcagcgactac

SEQ ID NO: 5267 - DNA, 339 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttactgggcctgccagggctgcgtcctaaccggcgtcggggtcatagcccacgagtgctgccaccacgccttcagcgactac

SEQ ID NO: 5268 - DNA, 331 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccccactgtttcaaacgctcgatccctcgctctttctcctacctcatctgggacatcatcatagcctcctgcttctactgcgtcgccaccacttacttccctctcctccctcaccctctctccgggcctgccagggctgcgtcctaaccggcgtctgggtcatagcccacgagtgcggccaccacgccttcagcgactac

SEQ ID NO: 5269 - DNA, 347 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccagggctgcgtcctaaccggcgtctgggtcatagcccacgagtgcggccaccacgccttcagcgactac

SEQ ID NO: 5270 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccaagggtgcgtcctaacgggcctctgggtcatcgcccacgaatgcggccaccacgccttcagcgactac

SEQ ID NO: 5271 - DNA, 329 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccccttacttccctctcctccctcaccctctctgggcctgccagggctgcgtcctaaccggcgtctgggtcatagcccacgagtgcggccaccacgccttcagcgactac

SEQ ID NO: 5272 - DNA, 342 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggccggccagggctgcgtcctaaccggcgtctgggtcatagcccacgagtgcggccaccacgccttcagcgactac

SEQ ID NO: 5273 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaaggctgcgtcctaacgggcctctgggtcatagcccgcgagtgcggccaccacgccttcagcgactac

SEQ ID NO: 5274 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgcttcaaacgctcgatccctcgctctttctcctacctcatctgggacatcatcatagcctcctgcttctactacgtcgccaccacttacttccctctcctcccccaccctctcccttcccttggcccctctactgggcctgccaaggctgcgtcctaacgggcgtctgggtcatcgcccacgaatgcggccaccacgccttcagcgactac

SEQ ID NO: 5275 - DNA, 340 bp, Artificial
  Mutation in BnaA.FAD2.a introduced by TALE nuclease pair BnFAD2_T01
caggatcaatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccagggctgcgtcctaaccggcgtctgggtcatagcccacgagtgcggccaccacgccttcagcgactac

SEQ ID NO: 5276 - DNA, 331 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccagggctgcgtcctaaccggcgtctgggtcatagcccacgagtgcggccaccacgccttcagcgacac

SEQ ID NO: 5277 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccagggctgcgtcctaaccggcgtctgggtcatagcccacgagcgcggccaccacgccttcagcgactac

SEQ ID NO: 5278 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgcctctctactgggcctgccagggctgcgtcctaacgggcctctgggtcatagcccacgagtgcggccaccacgccttcagcgactac

SEQ ID NO: 5279 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaaggctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacgcctctctactgggcctgccagggctgcgtccgaacgggcctctgggtcatagcccacgagtgcggccaccacgccttcagcgactac

SEQ ID NO: 5280 - DNA, 340 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctcccctccctcaccctctctcctcctctacgcggcctgccagggctgcgtcctaacgggcctctgggtcatagcccacgagtgcggccaccacgccttcagcgactac

SEQ ID NO: 5281 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggccggccaagggtgcgtcctaaccggcgtctgggtcatagcccacgagtgcggccaccacgccttcagcgactac

SEQ ID NO: 5282 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctacagggcctgccagggctgcgtcctaaccggcgtctgggtcatagcccacgagtgcggccaccacgccatcagcgactac

SEQ ID NO: 5283 - DNA, 409 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggggacggggcaggcgctgttgccggtgcggtgccaggcccacggcttgacccccctggcctctctactgggcctgccagggctgcgtcctaaccggcgtctgggtcatagcccacgagtgcggccaccacgccttcagcgactac

SEQ ID NO: 5284 - DNA, 441 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggtggccatcgccagccacgatggcggcaagcaggcgctggagacggtccagcggctgttcccggtgctgtgccaggcccacggcttgacccctggcctctctactgggccggccaaggctgcgtcctaacgggcctctgggtcatcgcccacgaatgcggccaccacgccttcagcgactac

SEQ ID NO: 5285 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacagcatcatagcctcctgcttctactacgtcgccaccacttacttccctctcctccctcaccctctctcctacctcctctctactgggcctgccagcgctgcgtcctaaccggcctctgggtcatagcccacgagtgctgccaccacgccttcagcaactac

SEQ ID NO: 5286 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttggcctctctactgggcctgccaagggtgcgtcctaaccggcgtctgggtcatagcccacgagtgcggccaccacgccttcagcgactac

SEQ ID NO: 5287 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgggcctgccagtgctgcgtcctaacgggcctctggttcatcgcccacgaatgcggccaccacgccttcagcgactac

SEQ ID NO: 5288 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccccttacttccctctcctccctcaccctctctcctacttcgcctgggccggccagtgctgcgtcctcacgggcctctgggtcatcgcccacgaatgcggccaccacgccttcagcgactac

SEQ ID NO: 5289 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcacccccacctctctactgggcctgccagggctgcgtcctaaccggcgtctgggtcatagcccacgagtgcggccaccacgccttcagcgactac

SEQ ID NO: 5290 - DNA, 329 bp, Artificial
  Mutation in BnaA.FAD2.a introduced by TALE nuclease pair BnFAD2_T01
caggatccatgggtgcaggtggaagaatgcaagtgtatcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgcgcctgccagggctgcgtcctaaccggcgtctgggtcatagcccacgagtgcggccaccacgccttcatcgactac

SEQ ID NO: 5291 - DNA, 343 bp, Artificial
  Mutation in BnaA.FAD2.a introduced by TALE nuclease pair BnFAD2_T01
caggatccatgggtgcaggtggaagaatgcaagtgtctcctccatccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacctctctactgggcctgccagggctgcgtcctaaccggcgtctgggtcatagcccacgagtgcggccaccacgccttcagcgactac

SEQ ID NO: 5292 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcttgcctctctactgggcctgccagggctgcgtccgaaccggcgtctgggtcatagcccgcgagtgcggccaccgcgccttcagcgactac

SEQ ID NO: 5293 - DNA, 325 bp, Artificial
  Mutation in BnaA.FAD2.a introduced by TALE nuclease pair BnFAD2_T01
caggatccatgggtgcaggtggaagaatgcaagtctatcatccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttggctgcgtcctaaccggcgtctgggtcatagcccacgtgtgcgtccaccacgccttcagcgactac

SEQ ID NO: 5294 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatcccttgctctttctcctacctcatctgggacatcatcatagcctcctgcttctactacgtcgccaccacttacttccctctcctccctcaccctctctcctacttctctactgggcctgccagggctgcgtcctaaccggcgtctgggtcatagcccacgagtgcggccaccacgccttcagcgactac

SEQ ID NO: 5295 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccaccagtgcggccaccacgccttcagcgactac

SEQ ID NO: 5296 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccacactgtttcaaacgctcgatccctcgctctttctcctacctcatctgggacatcatcatagcctcctgcttctactacgtcgccaccacttacttccctctcctccctcaccctctctcctactctggcctctctactgggcctgccaagggtgcgtcctaaccggcgtctgggtcatagcccacgagtgcggccaccacgccttcagcgactac

SEQ ID NO: 5297 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcatcgactac

SEQ ID NO: 5298 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgattctactacgtcgccaccacttacttccctctcctccctcaccctctctcctacttggcctctctactgggcctgccaagggtgcgtcctaaccggcgtctgggtcatagcccacgagtgcggccaccacgccttaagcgactac

SEQ ID NO: 5299 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctctatccctcgctctttctcctacctcatctgggacatcatcatagcctcctgcttctactacgtcgccaccacttacttccctctcctccctcaccctctctcctccttcggggcctctctactgggcctgccaagggtgcgtcctaacgggcctctgggtcatagcccacgagtgcggccaccacgccttcagcgactac

SEQ ID NO: 5300 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcgcctggcctctctactgggcctgccagggctgcgtcctaaccggcgtctgggtcatagcccacgaatgcggccaccacgccttcagcgactac

SEQ ID NO: 5301 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaaccccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 5302 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttcctctcctccctcaccctctctcctacttctgggcctctctactgggcctgccaagggtgcgtcctaaccggcgtctgggtcatagcccacgagtgcggccaccacgccttcagcgactac

SEQ ID NO: 5303 - DNA, 338 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactactgggcctgccaagggtgcgtcctaacgggcctctgggtcatcgcccacgaatgcggccaccacgccttcagcgactac

SEQ ID NO: 5304 - DNA, 337 bp, Artificial
  Mutation in BnaA.FAD2.a introduced by TALE nuclease pair BnFAD2_T01
caggatccatgggtgcaggtggaagaatgcaagtgtctcctccctccaaaaaggctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctccccctctctcctctactgggcctgccaagggtgcgtcctaacgggcctctgggtcatcgcccacgaatgcggccaccacgccttcagcgactac

SEQ ID NO: 5305 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcatgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 5306 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccggcctctctactgggcctgccagggctgcgtcctaaccggcgtcggggtcatagcccacgagtgcggccaccacgccatcagcgactac

SEQ ID NO: 5307 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactacctctctactgggcctgccaagggtgcgtcctaaccggcgtctgggtcatagcccacgagtgcggccaccacgccttcagcgactac

SEQ ID NO: 5308 - DNA, 338 bp, Artificial
  Mutation in BnaA.FAD2.a introduced by TALE nuclease pair BnFAD2_T01
caggatccatgggcgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctctctactgggcctgccaagggtgcgtcctaaccggggtctgggtcatagcccacgagtgcggccacgacgccttcagcgactac

SEQ ID NO: 5309 - DNA, 345 bp, Artificial
  Mutation in BnaA.FAD2.a introduced by TALE nuclease pair BnFAD2_T01
caggatccatgggtgcaggtggaagaatgcaagtgtctcccccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgcctctctactgggcctgccagggctgcgtcctaaccggcgtctaggtcatagcccacgtgtgcggccaccacgccttcagcgactac

SEQ ID NO: 5310 - DNA, 356 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctaccagggctgcgtcctaaccggcgtctgggtcatagcccacgagtgcggccaccacgccttcagcgactac

SEQ ID NO: 5311 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctggcctctctactgggcctgccaagggtgcgtcctaaccggcttctgggtcatagcccacgagtgcggccaccacgccttcagcgactac

SEQ ID NO: 5312 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaaacgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 5313 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgggcctgccagggctgcgtcctaactggcgtctgggtcatagcgcactagtgctgccaccacgccttcagcgactac

SEQ ID NO: 5314 - DNA, 338 bp, Artificial
  Mutation in BnaA.FAD2.a introduced by TALE nuclease pair BnFAD2_T01
caggatccatgggtgcaggtggaagaatgcaagtgtctcctccctcaaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattactgggcctgccagggctgcgtcctaaccggcgtctgggtcatagcccacgagtgcggccaccacgccttcagcgactac

SEQ ID NO: 5315 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 5316 - DNA, 335 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccagggctgcgtcctaaccggcgtctgtgtcatagcccacgagtgcggccaccacgccttcagcgactac

SEQ ID NO: 5317 - DNA, 421 bp, Artificial
  Mutation in BnaA.FAD2.a introduced by TALE nuclease pair BnFAD2_T01
caggatccatgggtgcaggtggaagaatgcaagtgtctcctccctccaaaaagcctgaaaccgacaacatcaagcgcgtaccctgcgagacaccgcccttcactgtcagagaactcaagcaagcaatcccaccgcactgtttcaaacgctcgatccatcgctctttctcctacctcatctgggacatcatcatagcctcctgcttctactacgtcgccaccacttacttccctctcctccctcaccctctctcctgccaggcatcaaataaaacgaaaggctcagtctcgggcgttcggctgcggcgagcggtatcagctcactcaaagcctggcctctctactgggcctgccaaggctgcgtcctaacgggcctctgggtcatagcccacgattgcggccaccacgccttcagcgactac

SEQ ID NO: 5318 - DNA, 421 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcagagaactcaagaaagcaatcccaccgcactgtttcaaacgctcgatccatcgctctttctcctacctcatctgggacatcatcatagcctcctgcttctactacgtcgccaccacttacttccctctcctccctcaccctctctcctgccaggcatcaaataaaacgaaaggctcagtctcggtcgttcggctgcggcgagcggtatcagctcactcaaagcctggcctctctactgggcctgccaaggctgcgtcctaacgggcctctgggtcatagcccacgagtgcggccaccacgccttcagcgactac

SEQ ID NO: 5319 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcatctgggacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgccttcagcgactac

SEQ ID NO: 5320 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgcctggcctctctactgggcctgccagggctgcgtcctaaccggcgtctgggtcatagcccacgagtgcggccaccacgccttcagcgactac

SEQ ID NO: 5321 - DNA, 386 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggccaccacctgctgggtggtcaagccgtgggcctggcacagtctctactgggcctgccagggctgcgtcctaaccggcgtctgggtcatagcccacgagtgcggccaccacgccttcagcgactac

SEQ ID NO: 5322 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtcggggtcatagcccacgagtgcggccaccacgccttcagcgactac

SEQ ID NO: 5323 - DNA, 354 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccttggcctctctactgggcctgccagggctgcgtcctaaccggcgtctgggtcatagcccacgagtgcggccaccacgccttcagcgactac

SEQ ID NO: 5324 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgcgacaccgcccttcactgtcggagaactcaagaaagcaatcccaccgcactgtttcaaacgctcgatccctcgctctttctcctacctcatctgggacatcatcatagcctcctgcttctacaacgtcgccaccacttacttccctctcctccctcaccctctctcctatcgcctctctactgggcctgccgagggtgcgtcctcaccggcgtcagggtcatagcccacgagtgcggccaccacgccgtcagcgactac

SEQ ID NO: 5325 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacctctggcctctctactgggcctgccaagggtgcgtcctaacgggcctctgggtcatagcccacgagtgcggccaccacgccttcagcgactac

SEQ ID NO: 5326 - DNA, 343 bp, Artificial
  Mutation in BnaA.FAD2.a introduced by TALE nuclease pair BnFAD2_T01
caggatccatgggtgcaggtggaagaatgtaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactccgtcgccaccacttacttccctctcctccctctccctctcccctacctctctactgggcctgccaaggctgcgtcctaacgggcctctgggtcatcgcccacgaatgcggccaccacgccttcagcgactac

SEQ ID NO: 5327 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgcctctctactgggcctgccagggctgcgtcctcaccggcgtctgggtcatagcccacgagtgcggccaccacgccttcagcgactac

SEQ ID NO: 5328 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccccgcctggcctctctactgggcctgccaagggtgcgtcctaacgggcctctgggtcatcgcccacgaatgcggccaccacgccttcagcgactac

SEQ ID NO: 5329 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccttgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccgcctggcctctctactgggcctgccaagggtgcgtcctaacgggcctctgggtcatcgcccacgaatgcggccaccacgccttcagcgactac

SEQ ID NO: 5330 - DNA, 339 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccggcctgccagggctgcgtcctaaccggcgtcggggtcatagcccgcgagtgcggccaccacgccttcagcgactac

SEQ ID NO: 5331 - DNA, 338 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccctctctactgggcctgccagggctgcgtcctaacgggcctctgggtcatagcccacgagtgcggccaccacgccttcagcgactac

SEQ ID NO: 5332 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacttcctggcctctctactgggcctgccagggctgcgtcctaaccggcgtctgggtcatagcccacgagtgcggccaccacgccttcagcgactac

SEQ ID NO: 5333 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccagggctgcgtcctaaccggcgtctgggtcatagcccacgagtgcggccaccacgccttcagcgactac

SEQ ID NO: 5334 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaagggtgcgtcctaaccggcgtctgggtcatagcccacgagtgcggccaccacgccgtcagcgactac

SEQ ID NO: 5335 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgccttggcctctctactgggccggccaagggtgcgtcctaaccggcgtctgggtcatagcccacgagtgcggccaccacgccgtcagcgactac

SEQ ID NO: 5336 - DNA, 356 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgacgcctggcctctctactgggcctgccaagggtgcgtcctaaccggcgtctgggtcatagcccacgagtgcggccaccacgccttcagcgactac

SEQ ID NO: 5337 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccatcaccctctcccccaccctctctactgggcctgccagggctgcgtcctaaccggcgtctgggtcatagcccacgagtgcggccaccacgccttcagcgactac

SEQ ID NO: 5338 - DNA, 351 bp, Artificial
  Mutation in BnaA.FAD2.a introduced by TALE nuclease pair BnFAD2_T01
caggatccatgggtgcaggtggaagaatgcaagtctctcctccctccaactcccccggaaccaaaaccctcaaacgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcggcctctctactgggcctgccagggctgcgtcctaaccggcgtctgggtcatagcccacgagtgcggccaccacgccttcagcgactac

SEQ ID NO: 5339 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccttggcctctctactgggcctgccagggctgcgtcctaaccggcgtctgggtcatagcccacgagtgcggccaccacgccttcagcgactac

SEQ ID NO: 5340 - DNA, 386 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttggccaccacctgctggggggtcaagccgtgggcctggcacagtctctactgggcctgccagggctgcgtcctaaccggcgtcggggtcatagcccacgagtgcggccaccacgccttcagcgactac

SEQ ID NO: 5341 - DNA, 355 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcgcctggcccctctactgggcctgccaaggctgcgtcctaacgggcctctgggtcatcgcccacgaatgcggccaccacgccttcagcgactac

SEQ ID NO: 5342 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtcggggtcagagcccacgagtgcggccaccacgccgtcagcgactac

SEQ ID NO: 5343 - DNA, 408 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttcgagccgaagtttccaaaaggtcgttgatcaaagctcgccgcgttgtttcatcaagccttggcctctctactgggcctgccagggctgcgtcctaaccggcgtctgggtcatagcccacgagtgcggccaccacgccttcagcgactac

SEQ ID NO: 5344 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagcctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcccttggcctctctactgggcctgccagggctgcgtcctaaccggcgtctgggtcatagcccacgattgcggccaccacgccttcagcgactac

SEQ ID NO: 5345 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcattatagcctcctgcttctactacgtcgccaccacttacttccctctcctccctcaccctctctcctacgtctggcctctctactgggcctgccagggctgcgtcctaaccggcgtctgggtcatagcccacgagtgcggccaccacgccttcagcgactac

SEQ ID NO: 5346 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagcctgaaaccgacaacatcaagcgcgtaccctgcgagacaccacccttcactgtcggagaactcaagaaagcaatcccaccgcactgtttcaaacgctcgatccctcgctctttctcctacctcatctgcgacatcatcatatcctcctgcttctaccacctcgccaccccttacttccctctcctccctcaccccctcccccacctggcccctctactgggcctgccagggctgcgtcctaacgggcgtctgggtcatagcccacgagtgcggccaccacgccttcagcgactac

SEQ ID NO: 5347 - DNA, 347 bp, Artificial
  Mutation in BnaA.FAD2.a introduced by TALE nuclease pair BnFAD2_T01
caggatccatgggtgcaggtggaagaatgcaagtgactcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgggcctctctactgggcctgccaagggtgcgtcctaaccggcgtctgggtcatagcccacgagtgcggccaccacgccatcagcgactac

SEQ ID NO: 5348 - DNA, 347 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttccctctctactgggcctgccagggctgcgtcctaaccggcgtctgggtcatagcccacgagtgcggccaccacgccttcagcgactac

SEQ ID NO: 5349 - DNA, 346 bp, Artificial
  Mutation in BnaA.FAD2.a introduced by TALE nuclease pair BnFAD2_T01
caggatccatgggtgcaggttgaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgagtgcggccaccacgccttcagcgactac

SEQ ID NO: 5350 - DNA, 318 bp, Artificial
  Mutation in BnaA.FAD2.a introduced by TALE nuclease pair BnFAD2_T01
caggatccatgggtgcaggtggaagaatgcaagtgtctcctccctccaaaaagcctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttggcaggcctctctactgggcctgccaagggggcgtcctaaccggcgtcggggtcatagcccgcgagtgcggccaccgcgccttcatcgactac

SEQ ID NO: 5351 - DNA, 312 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcacccggtgcgtcctaaccggcgtctgggtcatagcccacgagtgcggccaccacgccttcagcgactac

SEQ ID NO: 5352 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgctggcctctctactgggcctgccaagggtgcgtcctaaccggcgtctgggtcatagcccacgagtgcggccaccacgccttcagcgactac

SEQ ID NO: 5353 - DNA, 343 bp, Artificial
  Mutation in BnaA.FAD2.a introduced by TALE nuclease pair BnFAD2_T01
caggatccatgggtgcaggtggaagaatgcaagtgtcacctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacctctctactgggcctgcctgggctgcgtcctaaccggcgtctgggtcatagcccgcgagtgcggccaccacgccttcagcgactac

SEQ ID NO: 5354 - DNA, 331 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaaacgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccccctctccgggcctgccagggctgcgtcctaaccggcgtctgggtcatagcccacgagtgcggccaccacgccttcagcgactac

SEQ ID NO: 5355 - DNA, 332 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcacccactctctactgggcctgccagggctgcgtcctaaccggcgtctgggtcatagcccacgagtgcggaccacgccttcagcgactac

SEQ ID NO: 5356 - DNA, 341 bp, Artificial
  Mutation in BnaA.FAD2.a introduced by TALE nuclease pair BnFAD2_T01
caggatccattggtgcaggtggaagaatgcaagtgtctcctccctccaaaacgcctgaaaccgacaacctcaaacgcgtaccctgcgagacaccgcccttcactgtcggagaactcaagaaagcaatcccaccgcactgtttcaaacgctctatccctcgctctttctcctacctcatctgggacatcatcctagcctcctgcttctactacgtcgccaccacttacttccctctcctccctcaccctctctcccccctctactgggcctgccaagggtgcgtcctaaccggcgtctgggtcatagcccacgagtgcggccaccacgccttcagcgactac

SEQ ID NO: 5357 - DNA, 351 bp, Artificial
  Mutation in BnaA.FAD2.a introduced by TALE nuclease pair BnFAD2_T01
caggatccatgggtgcaggcggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcgtggcctctctactgggcctgccagggctgcgtcctaaccggcgtctgggtcatagcccacgattgcggccaccacgccttcatcgactac

SEQ ID NO: 5358 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccgccacttacttccctctcctccctcaccctctctcctacttggcctctctactgggcctgccagggctgcgtccgaaccggcgtcggggtcatagcccgcgagtgcggccaccacgccttcagcgactac

SEQ ID NO: 5359 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtggccaccccttacttccctctcctccctcaccctctctcctactccctggcctctctactgggcctgccagggctgcgtcctaaccggcgtctgggtcatagcccacgagtgcggccaccacgcattcagcgactac

SEQ ID NO: 5360 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatcactcgctctttctcctacctcatctgggacatcatcatagcctcctgcttctactacgtcgccaccacttacttccctctcctccctcaccctctcccctaggcctctctactgggcctgccaagggtgcgtcctaaccggcgtctgggtcatagcccacgagtgcggccaccacgccttcagcgactac

SEQ ID NO: 5361 - DNA, 348 bp, Artificial
  Mutation in BnaA.FAD2.a introduced by TALE nuclease pair BnFAD2_T01
caggatccatgggtgcaggtggaagaatgcaagtgtctcctccccccaaaaagcctgaaaccgacaacatccagcgcgtaccctgcgagacaccgcccttcactgtcggagaactcaagaaagcaatcccaccgcacggtttcaaacgctcgatccctcgctctttctcctacctcatctgggacatcatcatagcctcctgcttctactacgtcgccaccacttacttccctctcctccctcaccctctctcccacttggcctctctactgggcctgccaagggtgcgtcctaaccggcgtctgggtcatagcccacgagtgcggccaccacgccttcagcgactac

SEQ ID NO: 5362 - DNA, 261 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccacctcactgcttcaaacgctccatcccacgctccttctcctcttcgacatcatcatctcctcctcggctcctccctctaccacctctccacagcctacttccctctcccttaccacgccttcagcgactac

SEQ ID NO: 5363 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccccgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 5364 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccaccattgcggccaccacgccttcagcgactac

SEQ ID NO: 5365 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccagggctgcgtcctaacgggcctctgggtcatcgcccacgaatgcggccaccacgccttcagcgactac

SEQ ID NO: 5366 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacttggcctctctactgggccggccagggctgcgtcctaaccggcgtctgggtcatagcccacgagtgcggccaccacgccttcagcgactac

SEQ ID NO: 5367 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaacctacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 5368 - DNA, 346 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgagtgcggccaccacgccttcagcgactac

SEQ ID NO: 5369 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgtccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 5370 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccaagggtgcgtcctaaccggcgtctgggtcatagccaacgagtgcggccaccacgccttcagcgactac

SEQ ID NO: 5371 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccagggctgcgtcctaaccggcgtctgggtcatagcccacgagtgcggccaccacgccgtcagcgactac

SEQ ID NO: 5372 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaatggcctctctactgggcctgccagggctgcgtcctaacgggcctctgggtcatagcccacgagtgcggccaccacgccttcagcgactac

SEQ ID NO: 5373 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaacctacaacatcaagcgcgtaccctgcgagacaccgcccttcactgtcggagaactcaagaaagcaatcccaccgcactgtttcaaacgctcgatccctcgctctttctcctacctcaactgggacatcatcatagcctcctgcttctactacgtcgccaccacttacttccctctcctccctcaccctctctcctacttacctctctactgggcctgccaaggctgcgtcctaacgggcctctgggtcatagcccacgagtgcggccaccacgccttcagcgactac

SEQ ID NO: 5374 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggccggccaaggctgcgtccgaacgggcctcggggtcatagcccacgagtgcggccaccgcgccttcagcgactac

SEQ ID NO: 5375 - DNA, 335 bp, Artificial
  Mutation in BnaA.FAD2.a introduced by TALE nuclease pair BnFAD2_T01
caggatccatgggtgcaggtggaagaatgcaagtgtatcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctgccaaggctgcgtcctaacgggcctctgggtcatagcccacgagtgcggccaccacgccttcagcgactac

SEQ ID NO: 5376 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaaggctgcgtcctaacgggcctctgggtcatagcccacgagtgcggccaccacgccttcagcgactac

SEQ ID NO: 5377 - DNA, 393 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctccatccctcgctccttctcctacctcatctgggacatcatcatagcctcctgcttctactacgtcgccaccacttacttccctctcctccctcaccctctctcctacttcagcggctgttgccggggctgtgccaggcccacggcttgacccctggcctctctactgggcctgccaagggtgcgtcctaaccggcgtctgggtcatagcccacgagtgcggccaccacgccttcagcgactac

SEQ ID NO: 5378 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggccatcatcatagcctcctgcttctactacgtcccccccacttacttccctctcctccctcaccccctcccccacctggcctctctactgggcctgccagggctgcgtcctaaccggcgtctgggtcatagcccacgagtgcggccaccacgccttcagcgactac

SEQ ID NO: 5379 - DNA, 353 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacctcgcttgcccctctaccggggcggccggggctgcgtcccaaccggcgtcttggtcatagcccacgattgcggccaccgcgccctcatcgactacc

SEQ ID NO: 5380 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccagcgtctgggtcatagcccacgagtgcggccaccacgccttcagcgactac

SEQ ID NO: 5381 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggccggcctgggctgcttcctaaccggcgtctgggtcatagcccacgagtgcggccaccgcgccttcagcgactac

SEQ ID NO: 5382 - DNA, 345 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagccccgagtgcggccaccacgccttcagcgactac

SEQ ID NO: 5383 - DNA, 340 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccaagggtgcgtcctaaccggcgtctgggtcatagcccacgagtgcggccaccacgccgtcagcgactac

SEQ ID NO: 5384 - DNA, 340 bp, Artificial
  Mutation in BnaA.FAD2.a introduced by TALE nuclease pair BnFAD2_T01
caggatccatgagtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccaagggtgcgtcctaaccggcgtctgggtcatagcccacgagtgcggccaccacgccttcagcgactac

SEQ ID NO: 5385 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccaagggtgcgtcctaaccggcgtcttggtcatagcccacgagtgcggccaccacgccttcagcgactac

SEQ ID NO: 5386 - DNA, 337 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctctactgggcctgccagggctgcgtcctaaccggcgtctgggtcatagcccacgagtgcggccaccacgccttcagcgactac

SEQ ID NO: 5387 - DNA, 338 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctctctactgggcctgccaagggtgcgtcctaaccggcgtcggggtcatagcccacgagtgcggccaccacgccttcagcgactac

SEQ ID NO: 5388 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgcctctctactgggcctgccagggctgcgtcctaaccggcgtcggggtcatagcccacgagtgcggccaccacgccttcagcgactac

SEQ ID NO: 5389 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagcctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggccggccaagggtgcgtcctaaccggcgtctgggtcatagcccacgattgcggccaccacgccttcagcgactac

SEQ ID NO: 5390 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaaggctgcgtcctaacgggcctctgggtcatagcccacgagtgcggccaccacgccatcagcgactac

SEQ ID NO: 5391 - DNA, 347 bp, Artificial
  Mutation in BnaA.FAD2.a introduced by TALE nuclease pair BnFAD2_T01
caggatccatgggtgcaggtggaagaatgcaagtgtctcctccctctaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccagggctgcgtcctaaccggcgtctgggtcatagcccacgagtgcggccaccacgccttcagcgactac

SEQ ID NO: 5392 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgcgcctgccagggctgcgtcctaaccggcgtctgggtcatagcccacgagtgcggccaccacgccttcagcgactac

SEQ ID NO: 5393 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccccgcctggcctctctactgggcctgccaagggtgcgtcctaacgggcctcggggtcatagcccacgagtgcggccaccacgccttcagcgactac

SEQ ID NO: 5394 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcctctctactgggcctgccaaggctgtgtcctaacgggcctctgggtcatagcccacgagtgcggccaccacgccttcagcgactac

SEQ ID NO: 5395 - DNA, 426 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttatggacgccaactacctctgatagttgagtcgatacttcggcgatcaccgcttccctcataatgtttaactttgtgttggcctctctactgggcctgccagggctgcgtcctaaccggcgtctgggtcatagcccacgagtgcggccaccacgccttcagcgactac

SEQ ID NO: 5396 - DNA, 343 bp, Artificial
  Mutation in BnaA.FAD2.a introduced by TALE nuclease pair BnFAD2_T01
caggatccatgggtgcaggaggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctggcctctctactgggcctgccagggctgcgtcctaaccggcgtctgggtcatagcccacgagtgcggccaccacgccttcagcgactac

SEQ ID NO: 5397 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgactggcctctctactgggcctgccaagggtgcgtcctaaccggcgtctgggtcatagccctcgagtgcggccaccacgccttcagcgactac

SEQ ID NO: 5398 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctaccacgtcgccaccacttacttccctctcctccctcaccctctctcctacttgcctctctactgggcctgccaagggtgcgtcctaaccggcgtctgggtcatagcccacgagtgcggccaccacgccttcagcgactac

SEQ ID NO: 5399 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtccgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcatcgactac

SEQ ID NO: 5400 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccggcctctctactgggcctgccaagggtgcgtcctaaccggcgtctgggtcatagcccacgagtgcggccaccacgccttcagcgactac

SEQ ID NO: 5401 - DNA, 332 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccaacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcatagcccacgagtgcggccaccacgccttcagcgactac

SEQ ID NO: 5402 - DNA, 348 bp, Artificial
  Mutation in BnaA.FAD2.a introduced by TALE nuclease pair BnFAD2_T01
caggatccatgggtgcaggaggaagaatgcaagtgtgtacacacacaaaaaagtctgaaaccgacaacataaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggcgaccacgccttcagcgactac

SEQ ID NO: 5403 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcatacctcatctgggacatcatcatagcctcctgcttctactacgtcgccaccacttacttccctctcctccctcaccctctctcctacttctctctactgggcctgccaagggtgcgtcctaaccggcgtctgggtcatagcccacgagggcggccaccacgccttcagcgactac

SEQ ID NO: 5404 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtccgaaccggcgtctgggtcatagcccacgagtgcggccaccacgccttcagcgactac

SEQ ID NO: 5405 - DNA, 346 bp, Artificial
  Mutation in BnaA.FAD2.a introduced by TALE nuclease pair BnFAD2_T01
caggatccatgggtgcaggtggcagaatgcaagtgtatcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaacctgcgtctgggtcatagcccacgagtgcggccaccacgccttcagcgactac

SEQ ID NO: 5406 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacttggcctctctactgggcctgccagggctgcgtcctaaccggcgtctgggtcatagcccacgagtgcggccaccacgccttcagcgactac

SEQ ID NO: 5407 - DNA, 349 bp, Artificial
  Mutation in BnaA.FAD2.a introduced by TALE nuclease pair BnFAD2_T01
caggattcatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 5408 - DNA, 349 bp, Artificial
  Mutation in BnaA.FAD2.a introduced by TALE nuclease pair BnFAD2_T01
caggattcatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtcggggtcatagcccacgagtgcggccaccacgccttcagcgactac

SEQ ID NO: 5409 - DNA, 341 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatcccacgctctttctcctacctcatctgggacatcatcatagcctcctgcttctactacgtcgccaccacttacttccctctcctccctcaccctctctcctacctctactgggcctgccagggctgcgtcctaaccggcgtctgggtcatagcccacgagtgcggccaccacgccttcagcgactac

SEQ ID NO: 5410 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgaatgcggccaccacgccttcagcgactac

SEQ ID NO: 5411 - DNA, 331 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatcccacgctccttctcctcttcgacatcatcatagcctcctgcttctactacgtcgccaccacttacttccctctcctccctcaccctctctcctattactgggcctgccagggctgcgtcctaaccggcgtctgggtcatagcccacgagtgcggccaccacgccttcagcgactac

SEQ ID NO: 5412 - DNA, 342 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccagggctgcgtcctaaccggcgtctgggtcatagcccacgagtgcggccaccacgccttcacgactac

SEQ ID NO: 5413 - DNA, 356 bp, Artificial
  Mutation in BnaA.FAD2.a introduced by TALE nuclease pair BnFAD2_T01
caggatccatgggtgcaggtggaagaatgcaagtgtctcctccctccaagaagcctgaaaccgacaccctcaagcgcgtaccctgcgagacaccgcccttcactgtcggagaaatcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccagggctgcgtcctaaccggcgtctgggtcatagcccacgagtgcggccaccacgccttcagcgactac

SEQ ID NO: 5414 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctccccctctctcctgcctctctactgggcctgccagggctgcgtcctaaccggcggctgggtcatagcccacgagtgcggccaccacgccttcagcgactac

SEQ ID NO: 5415 - DNA, 346 bp, Artificial
  Mutation in BnaA.FAD2.a introduced by TALE nuclease pair BnFAD2_T01
caggatccatgggtgcagggggaagaatgcaagtgtatactccctcaaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacttcctctctactgggcctgccagggctgcggccggaccggcgtcgggggcatagcccgcgagtgctgcgaccgcgcctacaacgactac

SEQ ID NO: 5416 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccggcctctctactgggcctgccagggctgcgtcctaacgggcctctgggtcatagcccacgagtgcggccaccacgccttcagcgactac

SEQ ID NO: 5417 - DNA, 348 bp, Artificial
  Mutation in BnaA.FAD2.a introduced by TALE nuclease pair BnFAD2_T01
caggatccatgggtgcaggtggcagaatgcaagtgtctcctccatccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcggctggggcatagcccacgagtgcggccaccacgccttcagcgactac

SEQ ID NO: 5418 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcggcctctctactgggcctgccagggctgcgtcctaaccggcgtctgggtcatagcccacgagtgcggccaccacgccatcagcgactac

SEQ ID NO: 5419 - DNA, 356 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgacgcctggcctctctactgggcctgccaagggtgcgtcctaaccggcgtctgggtcatagcccacgagtgcggccaccacgccttcagcgactac

SEQ ID NO: 5420 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccccccttcactgtcggagaactcaagaaagcaatcccaccgcactgtttcaaacgctcgatccctcgctctttctcctacctcatctgggacatcatcatagcctcctgcctctactacgtcgccaccacttacttccctctcctccctcaccctctcccccacgcctctctactgggcctgccaaggctgcgtcctaacgggcgtctgggtcatagcccacgagtgcggccaccacgccttcagcgactac

SEQ ID NO: 5421 - DNA, 321 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcaagggtgcgtcctaaccggcgtctgggtcatagcccacgagtgcggccaccacgccttcagcgactac

SEQ ID NO: 5422 - DNA, 350 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaacgggcctctgggtcatcgcccacgaatgcggccaccacgccttcagcgactac

SEQ ID NO: 5423 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttactcccctctcctccctcaccctctctccttggcctctctactgggcctgccaaggctgcgtcctaacgggcctctgggtcatagcccacgagtgcggccaccacgccttcagcgactac

SEQ ID NO: 5424 - DNA, 332 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccagggctgcgtcctaaccggcgtctgggtcatagcccacgagtgtggccaccacgccttcagcgactac

SEQ ID NO: 5425 - DNA, 349 bp, Artificial
  Mutation in BnaA.FAD2.a introduced by TALE nuclease pair BnFAD2_T01
caggatccatgggtgcaggtggaagaatgcaagtgtctactcccaccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagccccctgcttctactacgtcgccaccacttacttccctcacctccctcaccctctctcctacttcggcctctctacggggcctgccagggctgcgtcctaaccggcgtctggggcatagcccacgagtgcggccaccacgccttcagcgactac

SEQ ID NO: 5426 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccccctctcctccttcgcccctggcctctctactgggcctgccagggctgcgtcctaaccggcgtctgggtcatagcccacgagtgcggccaccacgccttcagcgactac

SEQ ID NO: 5427 - DNA, 341 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctcccctacctcgccataaactgccagggctgcgtcctaaccggcgtctgggtcatagcccacgagtgcggccaccacgccttcagcgactac

SEQ ID NO: 5428 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgcttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 5429 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctggcctctctactgggcctgccaagggtgcgtcctaaccggcgtctgggtcatagcccacgagtgcgtccaccacgccttcaacgactac

SEQ ID NO: 5430 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctacgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttctactgggcctgccagggctgcgtcctaaccggcgtctgggtcatagcccacgagtgtggccaccacgccttcagcgactac

SEQ ID NO: 5431 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtctgagaactcaagaaagcaatcccaccgcactgtttcaaacgctcgatccctcgctccttctcctcttcgacatcatcatctcctcctcggctcctccctctaccacctctccacagcctacttccctctcctccctcaccctctctcctacggcctctctactgggcctaccaagggtgcgtcctaaccggcgtctgggtcatagcccacgagtgcggccaccacgccttcagcgactac

SEQ ID NO: 5432 - DNA, 348 bp, Artificial
  Mutation in BnaA.FAD2.a introduced by TALE nuclease pair BnFAD2_T01
caggatccatgggtgcaggtggaagaatgcaagtgtctccccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccagggctgcgtcctaaccggcgtctgggtcatagcccacgagtgcggccaccacgccttcagcgactac

SEQ ID NO: 5433 - DNA, 348 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcctctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 5434 - DNA, 347 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcgcctctctactgggcctgccagggctgcgtcctaaccggcgtctgggtcatagcccacgagtgcggccaccacgccttcagcgactac

SEQ ID NO: 5435 - DNA, 345 bp, Artificial
  Mutation in BnaA.FAD2.a introduced by TALE nuclease pair BnFAD2_T01
caggatccatgggtgcaggtggaagaatgcaagtgtctactccctccaaaaggtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttcggctctctactgggcctgccaagggtgcgtcctaaccggcgtctgggtcatagcccacgagtgcggccaccacgccttcagcgactac

SEQ ID NO: 5436 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctggcctctctactgggcctgccaagggtgcgtcctaaccggcgtctgggtcatagcccacgagtgcggccaccacgccttcagcgactac

SEQ ID NO: 5437 - DNA, 350 bp, Artificial
  Mutation in BnaA.FAD2.a introduced by TALE nuclease pair BnFAD2_T01
caggatccatgggtgcaggtggaagaatgcaagtgtatcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttggcctctctactgggcctgccaagggtgcgtcctaaccggcgtctgggtcatagcccacgagtgcggccaccacgccttcagcgactac

SEQ ID NO: 5438 - DNA, 335 bp, Artificial
  Mutation in BnaA.FAD2.a introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccagggctgcgtcctaaccggcgtctgggtcatagcccacgagtgtggccaccacgccttcagcgactac

SEQ ID NO: 5439 - DNA, 346 bp, Artificial
  Mutation in BnaA.FAD2.a introduced by TALE nuclease pair BnFAD2_T01
caggatccagggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 5440 - DNA, 356 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgtgtcatagcccacgagtgcggccaccacgccttcagcgactac

SEQ ID NO: 5441 - DNA, 387 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgaccccggagcaggtggtggccatcgccagccacgatggcgcctggcctctctactgggcctgccagggctgcgtcctaaccggcgtctggggcatagcccacgagtgcggccaccacgccttcagcgactac

SEQ ID NO: 5442 - DNA, 409 bp, Artificial
  Mutation in BnaA.FAD2.a introduced by TALE nuclease pair BnFAD2_T01
caggatccatgggtgcaggtggaagaatgcaagtgtctcctccctcccaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggagacggtgcaggcgctgttgccggtgctgtgccaggcccacggcttgacccccctggcctctctactgggcctgccagggctgcgtcctaaccggcgtctgggtcatagcccacgagtgcggccaccacgccttcagcgactac

SEQ ID NO: 5443 - DNA, 339 bp, Artificial
  Mutation in BnaA.FAD2.a introduced by TALE nuclease pair BnFAD2_T01
caggatccatgggtgcatgtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctggcctctctactgggcctgccaagggtgcgtcctaaccggcgtctgggtcatagcccacgagtgcggccaccacgccttcagcgactac

SEQ ID NO: 5444 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctggcctctctactgggcctgccagggctgcgtcctaaccggcgtctgggtcatagcccacgagggcggccaccacgccttcagcgactac

SEQ ID NO: 5445 - DNA, 351 bp, Artificial
  Mutation in BnaA.FAD2.a introduced by TALE nuclease pair BnFAD2_T01
caggatccatgggtgcagatggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatggcctcctgcttctactacgtcgccaccacttactcccctctcctccctcaccctctctcctattgcctggcctctctactgggcctgccagggctgcgtcctaacgtgcctctgggtcatagcccacgagtgcggccaccacgccttcagcgactac

SEQ ID NO: 5446 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctggcctctctactgggcctgccaagggtgcgtcctaaccggcgtctgggtcatagcccacgagtgcggccaccacgccttcagcgactac

SEQ ID NO: 5447 - DNA, 330 bp, Artificial
  Mutation in BnaA.FAD2.a introduced by TALE nuclease pair BnFAD2_T01
cagtatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgggcctgccagggctgcgtcctaaccggcgtctgggtcatagcccacgagtgcggccaccacgccttcacgactac

SEQ ID NO: 5448 - DNA, 348 bp, Artificial
  Mutation in BnaA.FAD2.a introduced by TALE nuclease pair BnFAD2_T01
caggatccatgggtgcaggtggaagaatgcaagtgactcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaacgggcctctgggtcatcgcccacgaatgcggccaccacgccttcagcgactac

SEQ ID NO: 5449 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccagggctgcgtcctaacgggcctctgggtcatagcccacgagtgcggccaccacgccttcagcgactac

SEQ ID NO: 5450 - DNA, 339 bp, Artificial
  Mutation in BnaA.FAD2.a introduced by TALE nuclease pair BnFAD2_T01
caggatccatgggtgcaggtggcagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttactgggcctgccagggctgcgtcctaaccggcgtctgggtcatagcccacgagggcggccaccacgccttcagcgactac

SEQ ID NO: 5451 - DNA, 347 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttccctgcccctctactgggcctgccaaggctgcgtcctaacgggcctctgggtcatagcccacgagtgcggccaccacgccttcagcgactac

SEQ ID NO: 5452 - DNA, 350 bp, Artificial
  Mutation in BnaA.FAD2.a introduced by TALE nuclease pair BnFAD2_T01
caggatccatgggtgcaggtggaagaatgcaagtgactcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 5453 - DNA, 348 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaggaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 5454 - DNA, 346 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccagggctgcgtcctaaccggcgtctgggtcatagcccacgagtgcggccaccacgccttcagcgactac

SEQ ID NO: 5455 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgccctctctactgggcctgccaagggtgcgtcctaaccggcgtctgggtcatagcccacgagtgcggccaccacgccttcagcgactac

SEQ ID NO: 5456 - DNA, 390 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttgctggcgatggccaccacctgctggggggtcaagccgtgggcggcctctctactgggcctgccaagggtgcgtcctaaccggcgtctgggtcatagcccacgagtgcggccaccacgccttcagcgactac

SEQ ID NO: 5457 - DNA, 356 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccagggctgcgtcctaacgggcctctgggtcatagcccacgagtgcggccaccacgccttcagcgactac

SEQ ID NO: 5458 - DNA, 343 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaactctctactgggcctgccaagggtgcgtcctaaccggcgtctgggtcatagcccacgagtgcggccaccacgccttcagcgactac

SEQ ID NO: 5459 - DNA, 344 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctggcctctctactgggcctgccagggctgcgtcctaaccggcgtctgggtcatagcccacgagtgcggccaccacgccttcagcgactac

SEQ ID NO: 5460 - DNA, 357 bp, Artificial
  Mutation in BnaA.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcgcgcctggcctctctactgggcctgccagggctgcgtcctaaccggcgtctgggtcatagcccacgagtgcggccaccacgccttcagcgactac

SEQ ID NO: 5461 - DNA, 312 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccatgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttacctctcctccctcaccctgtgcgtcctaaccggcgtctgggtcatagcccacgagtgcggccaccacgccttcagcgactac

SEQ ID NO: 5462 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacatcatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgcctctctactgggcctgccagggctgcgtcctaaccggcgtctgggtcatagcccacgagtgcggccaccacgccttcagcgactac

SEQ ID NO: 5463 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgctcctactacgtcgccaccacttacttccctctcctccctcaccctctctcctgcctctctactgggcctgccagggctgcgtcctaaccggcgtctgggtcatagcccacgagggcggccaccacgccttcagcgactac

SEQ ID NO: 5464 - DNA, 335 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccagggctgcgtcctaacgggcctctgggtcatcgcccacgaatgcggccaccacgccttcagcgactac

SEQ ID NO: 5465 - DNA, 349 bp, Artificial
  Mutation in BnaA.FAD2.a introduced by TALE nuclease pair BnFAD2_T01
caggatccatgggtgcaggtggaagaatgcaagtgtctactccctccaaaaagtctgaaatcgacaacatcaagcgagtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctctctactgggcctgccagggctgcgtcctaaccggcgtctgggtcatagcccacgattgcggccaccacgccttcagcgactac

SEQ ID NO: 5466 - DNA, 346 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgagtgcggccaccacgccttcagcgactac

SEQ ID NO: 5467 - DNA, 380 bp, Artificial
  Mutation in BnaA.FAD2.a introduced by TALE nuclease pair BnFAD2_T01
caggacccatgggtgcaggtggaagaatgcaagtctctcctccctccagctcccccaaaaccaaaaccctcaaacgcgtcccctgcgagacaccacccttcactctcggagacctcaagaaagcaatcccacctcactgcttcaaacgctcgacccctcgctctttctcctacctcatctgggacatcatcatagcctcctgcttctactacgtcgccaccacttacttccctctcctccctcaccctctctcctacttcacaggggtccggcgcccgcgctctggaggcccgcctctctactgggcctgccagggctgcgtcctaaccggcgtctgggtcatagcccacgagtgcggccaccacgccttcagcgactac

SEQ ID NO: 5468 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccagggctgcgtcctaaccggcgtctggggcatagcccacgagtgcggccaccacgccttcagcgactac

SEQ ID NO: 5469 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgcgacaccgcccttcactgtcggagaactcaagaaagcaatcccacctcactgtttcaaacgctcgatccctcgctctttctcctacctcatctgggacatcatcatagcctcctgcttctactacgtcgccaccacttacttccctctcctccctcaccctctctcctacgttggcctctctactccgcctgccaatggtgcttcctaaccggcttcttcttcatagcccacgagtcctgccaccacgccttcatcgactcc

SEQ ID NO: 5470 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcattgcccacgagtgcggccaccacgccttcagcgactac

SEQ ID NO: 5471 - DNA, 349 bp, Artificial
  Mutation in BnaA.FAD2.a introduced by TALE nuclease pair BnFAD2_T01
caggatccatgggtgcaggtggaagaatgcaagtgtctcctccctcctaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgtgcctgccagggctgcgtcctaaccggcgtctgggtcatcgcccaccagtccgtcccccccgccttcagcgcctac

SEQ ID NO: 5472 - DNA, 345 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtacactgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgccttcagcgactac

SEQ ID NO: 5473 - DNA, 339 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttactgggcctgccagggctgcgtcctaacgggcctctgggtcatagcccacgagtgcggccaccacgcctgcagcgactac

SEQ ID NO: 5474 - DNA, 338 bp, Artificial
  Mutation in BnaA.FAD2.a introduced by TALE nuclease pair BnFAD2_T01
caggatccatgggtgcaggtggcagaatgcaagtgtatcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgctaccacttacttccctctcctccctcaccctctctctctctactgggcctgccaagggtgcgtcctaaccggcgtctgggtcatagcccacgagtgcggccaccacgcctgcagcgactac

SEQ ID NO: 5475 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaacgggcgtctgggtcatagcccacgagtgcggccaccacgccttcagcgactac

SEQ ID NO: 5476 - DNA, 345 bp, Artificial
  Mutation in BnaA.FAD2.a introduced by TALE nuclease pair BnFAD2_T01
caggatccatgggtgcaggtggcagaatgcaagtatctaccccctcaaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgccttcagcgactac

SEQ ID NO: 5477 - DNA, 351 bp, Artificial
  Mutation in BnaA.FAD2.a introduced by TALE nuclease pair BnFAD2_T01
caggatccatgggtgcaggtggaagaatgcaagtgtctactcactccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcggcctctctactgggcctgccagggctgcgtcctaaccggcgtctgggtcatagcccacgagtgcggcctccacgcctgcagcgactac

SEQ ID NO: 5478 - DNA, 348 bp, Artificial
  Mutation in BnaA.FAD2.a introduced by TALE nuclease pair BnFAD2_T01
caggatccatgggtgcaggtggaagaatgcaagtgtatcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 5479 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgggcctctctactgggcctgccaaggctgcgtcctaacgggcgtctgggtcatagcccacgagtgcggccaccacgccttcagcgactac

SEQ ID NO: 5480 - DNA, 357 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctccccccgcctggcctctctactgggcctgccggggctgcgtcctaaccggcgtctgggtcatagcccacgagtgcggccaccacgccttcagcgactac

SEQ ID NO: 5481 - DNA, 350 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaacgggcctctgggtcatagcccacgagtgcggccaccacgccttcagcgactac

SEQ ID NO: 5482 - DNA, 449 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccccacctccgccaggcccacggcttgaccccccagcgggtgggggccatcgccagcaatggcggtggcaagcaggcgctggagacggtccagcggctgttgccggtgctggcctctctactgggcctgccagggctgcgtcctaaccggcgtctgggtcatagcccacgagtgcggccaccacgccttcagcgactac

SEQ ID NO: 5483 - DNA, 341 bp, Artificial
  Mutation in BnaA.FAD2.a introduced by TALE nuclease pair BnFAD2_T01
caggatccatgtgtgcaggtggaagaatgcaagtgtctactccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctggcctctctactgggcctgccagggctgcgtcctaaccggcgtctgggtcatagcccacgagtgcggccaccacgccttcagcgactac

SEQ ID NO: 5484 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctccatccctcgctccttctcctacctcatctgggacatcatcatagcctcctgcttctactacctcgcccccacttacttccctcccctccctctccctctctcctactttggcctctctactgggcctgccagggctgcgtcctaaccggcgtctgggtcatagcccacgagtgcggccaccacgccttcagcgactac

SEQ ID NO: 5485 - DNA, 356 bp, Artificial
  Mutation in BnaA.FAD2.a introduced by TALE nuclease pair BnFAD2_T01
caggatccatgggtgcaggtggaagaatgcaagtgtttaatccctccaaaaagtctgaaaccgacaacatcaagcgcgtaccctgcgagacaccgcccttcactgtcggagaactcaagaaagcaatcccaccgcactgtttcaaacgctcgatccctagctctttctcctacctcatctgggacatcatcatagcctcctgcttctactacgtcgccaccacttacttccctctcctccctcaccctctcgcctacttcgccgcctggcctctctactgggcctgccagggctgcgtcctaaccggcgtcggtgtcatagcccacgtgggcgtccaccgcgccttcaacgactac

SEQ ID NO: 5486 - DNA, 349 bp, Artificial
  Mutation in BnaA.FAD2.a introduced by TALE nuclease pair BnFAD2_T01
caggatccatgggtgcaggtggaagaatgcaagtgtctcctcactccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactatggcctctctactgggcctgccaagggtgcgtcctaaccggcgtctgggtcatagcccacgagtgcggccaccacgccttcagcgactac

SEQ ID NO: 5487 - DNA, 349 bp, Artificial
  Mutation in BnaA.FAD2.a introduced by TALE nuclease pair BnFAD2_T01
caggatccatgggtgcaggtgtaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaactggcgtctgggtcatcgcccacgaatgcggccaccacgccttcagcgactac

SEQ ID NO: 5488 - DNA, 345 bp, Artificial
  Mutation in BnaA.FAD2.a introduced by TALE nuclease pair BnFAD2_T01
caggatccatgggtgcaggtggtagaatgcaagtctctcctccctccagctcccccggaaccaacaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccagggctgcgtcctaaccggcgtctgggtcatagcccacgagtgcggccaccacgccttcagcgactac

SEQ ID NO: 5489 - DNA, 435 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagacctcaagaaagcaatcccacctcactgcttcaaacgctccatcccacgctccttctcctcttcgacatcatcatctcctcctcggctcctccctctaccacctctccacagcctacttccctctcctccctcaccctcggctgttgccggtgctgtgccaggcccacggcttgaccccccagcaggtggtggccatcgccagcaatggcggtggcaagcaggcgctggaggcctggcctctctactgggcctgccaaggctgcgtcctaacgggcctctgggtcatagcccacgagtgcggccaccacgccttcagcgactac

SEQ ID NO: 5490 - DNA, 261 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctccttctcctcttcgacatcatcatctcctcctcggctcctccctctaccacctctccacagcctacttccctctcccttaccacgccttcagcgactac

SEQ ID NO: 5491 - DNA, 349 bp, Artificial
  Mutation in BnaA.FAD2.a introduced by TALE nuclease pair BnFAD2_T01
caggatccatgggtgcaggtggaagaatgcaagtgtgtcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgctttggcctctctactgggcctgccaagggtgctgcctcaccggcgactgggtcattgcccacgagtgcggccaccacgccttcaacgactac

SEQ ID NO: 5492 - DNA, 346 bp, Artificial
  Mutation in BnaA.FAD2.a introduced by TALE nuclease pair BnFAD2_T01
caggatccatgggtgcaggtggaagaatgcaagtgtctactccctcaaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccagggctgcgtcctaaccggcgtctgggtcatagcccacgagtgctgccaccacgccttcagcgactac

SEQ ID NO: 5493 - DNA, 339 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctggcctctctactgggcctgccagggctgcgtcctaaccggcgtctgggtcatagcccacgagtgcggccaccacgccttcagcgactac

SEQ ID NO: 5494 - DNA, 349 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 5495 - DNA, 357 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcccctctactgggcctgccaaggctgcgtcctaacgggcctctgggtcatcgcccacgaatgcggccaccacgcccttcagcgactac

SEQ ID NO: 5496 - DNA, 348 bp, Artificial
  Mutation in BnaA.FAD2.a introduced by TALE nuclease pair BnFAD2_T01
caggatccatgggtgcaggtggcagaatgcaagtgtctactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacgtggcctctctactgggcctgccagggctgcgtcctaaccggcgtctgggtcatagcccacgagtgcggccaccgcgcctacagcgactac

SEQ ID NO: 5497 - DNA, 335 bp, Artificial
  Mutation in BnaA.FAD2.a introduced by TALE nuclease pair BnFAD2_T01
caggatccatgggtgcaggtggaagaatgcaagtgtctcctccctcccaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctactgggccagccagggctgcgtcctaaccggcgtctgggtcatagcccgcgagtgcggccaccacgccttcagcgactac

SEQ ID NO: 5498 - DNA, 343 bp, Artificial
  Mutation in BnaA.FAD2.a introduced by TALE nuclease pair BnFAD2_T01
caggatccatgggtgcaggtggaagaatgcaagtctctactccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccactgacttccctctcctccctcaccctctctctggcctctctactgggcctgccatggctgcgtcctaaccggcgtctgggtcatagcccacgagtgcggccaccacgccatcagcgactac

SEQ ID NO: 5499 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctactgggcctgccaaggctgcgtcctaacgggcctctgggtcatcgcccacgaatgcggccaccacgccttcagcgactac

SEQ ID NO: 5500 - DNA, 341 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttactgggcctgccagggctgcgtcctaaccggcgtctgggtcatagcccacgagtgcggccaccacgcctgcagcgactac

SEQ ID NO: 5501 - DNA, 335 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccactgcactgtttcaaacgctcgatccctcgctctttctcctacctcatctgggacatcatcatagcctcctgcttctactacgtcgccaccacttacttccctctcctccctcaccctctctcctactgggcctgccagggctgcgtcctaaccggcgtctgggtcatagcccacgagtgcggccaccacgccttcagcgactac

SEQ ID NO: 5502 - DNA, 345 bp, Artificial
  Mutation in BnaA.FAD2.a introduced by TALE nuclease pair BnFAD2_T01
caggatccatgggtgcaggtggaagaatgcaagtgtttcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccagggctgcgtcctaaccggcgtctgggtcatagcccacgagggcggccaccacgccttcagcgactac

SEQ ID NO: 5503 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccagggctgcgtcctaaccggcgtctgggtcatagcccacgagtgcggccaccacgcctgcagcgactac

SEQ ID NO: 5504 - DNA, 417 bp, Artificial
  Mutation in BnaA.FAD2.a introduced by TALE nuclease pair BnFAD2_T01
caggatccatgggtgcaggtggaagaatgcaagtgtctcctccctccaacaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgcccccacttacttccctctcctccctctccctctctcctccttcgtcaggacatgatcgcagcgttgccagagcgagattctccgcgctgtagaagtcaccattgttgtgctggcctctctactgggcctgccagggctgcgtcctaaccggcgtctgggtcatagcccacgagtgcggccaccacgccttcagcgactac

SEQ ID NO: 5505 - DNA, 347 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaatggcctctctactgggcctgccagggctgcgtcctaaccggcgtctgggtcatagcccacgagtgcggccaccacgccttcagcgactac

SEQ ID NO: 5506 - DNA, 343 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccagggctgcgtcctaaccggcgtctgggtcatagcccacgagttcggccaccacgccttcagcgactac

SEQ ID NO: 5507 - DNA, 339 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatttgggacatcatcctagcctcctgcttctactacgtcgccaccacttacttccctctcctccctcaccctctggcctctctactgggcctgccaagggtgcgtcctaaccggcgtctgggtcatagcccacgagtgcggccaccacgccttcagcgactac

SEQ ID NO: 5508 - DNA, 349 bp, Artificial
  Mutation in BnaA.FAD2.a introduced by TALE nuclease pair BnFAD2_T01
caggatccatgggtgcaggtggaagaatgcaagtgtatactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 5509 - DNA, 354 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacatcgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgtggtggcctctctactgggcctgccaagggtgcgtcctaaccggcgtctgggtcatagcccacgagtgcggccaccacgccttcagcgactac

SEQ ID NO: 5510 - DNA, 344 bp, Artificial
  Mutation in BnaA.FAD2.a introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatcctctctactgggcctgccagggctgcgtcctaaccggcgtctgggtcatagcccacgagtgcggccaccacgccttcagcgactac

SEQ ID NO: 5511 - DNA, 349 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 5512 - DNA, 318 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttggcaggcctctctactgggcctgccaagggtgcgtcctaaccggcgtctgggtcatatcccacgagtgcggccaccacgccttcagcgactac

SEQ ID NO: 5513 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccagggctgcgtcctaaccggcgtcggggtcatagcccacgagtgcggccaccacgcctgcagcgactac

SEQ ID NO: 5514 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctccttctcctacctcatctgggacatcatcatagcctcctgcttctactacgtcgccaccacttacttccctctcctccctcaccctctctcctacgtctggcctctctactgggcctgccagggctgcgtcctaaccggcgtctgggtcatagcccacgagtgcggccaccacgccttcagcgactac

SEQ ID NO: 5515 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcgctggcctctctactgggcctgccaagggtgcgtcctaaccggcctctgggtcatagcccacgagtgcggccaccacgccttcagcgactac

SEQ ID NO: 5516 - DNA, 345 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaccatcaagcgcgtaccctgcgagacaccgcccttcactgtcggagaactcaagaaagcaatcccacctcactgcttcaaacgctcgatccctcgctctttctcctacctcatctgggacatcatcatagcctcctgcttctactacgtcgccaccacttacttccctctcctccctcaccctctctcctaggcctctctactgggcctgccagggctgcgtcctaaccggcgtcggggtcatagcccacgagtgcggccaccacgccttcagcgactac

SEQ ID NO: 5517 - DNA, 343 bp, Artificial
  Mutation in BnaA.FAD2.a introduced by TALE nuclease pair BnFAD2_T01
caggatccatgggcaggtggaacaatgcgagtgtctactcaccccaaaaagtctgaaaccgacaaccccacgcgcgtaccctgcgagacaccccccttcactgtcggagaactcaagaaagcaatcccaccgcactgtttcaaacgctcgatccctcgctctttctcctacctcatctgggacatcatcatagcctcctgcttctactacgtcgcccccacttacttccctctcctccctccccctctctcctaggcctctctactggtcctgccatggctgcgtcctaaccggcgtctgggtcatagcccatgagggcggccagcacgccttctgcgactac

SEQ ID NO: 5518 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccctggcctctctactgggcctgccagggctgcgtcctaacgggcctctgggtcatcgcccacgaatgcggccaccacgccttcagcgactac

SEQ ID NO: 5519 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctggcctctctactgggcctgccagggctgcgtcctaaccggcgtctgggtcatagcccacgagtgcggccaccacgcctccagcgactac

SEQ ID NO: 5520 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttacccctctactgggcctgccaaggctgcgtcctaacgggcgtctgggtcatagcccacgagtgcggccaccacgccttcagcgactac

SEQ ID NO: 5521 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccagggctgcgtcctaaccggcgtctgggtcatagcccacgagtgcggccaccacgccttcagcgactac

SEQ ID NO: 5522 - DNA, 347 bp, Artificial
  Mutation in BnaA.FAD2.a introduced by TALE nuclease pair BnFAD2_T01
caggatccatgggtgcaggtggaagaatgcaagtgtctcctcactccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggcctccacgcctgcagcgactac

SEQ ID NO: 5523 - DNA, 409 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcaaataatgattttattttgactgatagtgacctgttcgttgcaacaaatggatgagctctctactgggcctgccaagggtgcgtcctaaccggcgtctgggtcatagcccacgagtgcggccaccacgccttcagcgactac

SEQ ID NO: 5524 - DNA, 343 bp, Artificial
  Mutation in BnaA.FAD2.a introduced by TALE nuclease pair BnFAD2_T01
caggatccatgggtgcaggtggaagaatgcaagtttctcctccctccagctcccccgaaaccaaaaccatcaaacgcgtcccctgcgagacaccacccatcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccagggctgcgtcctaaccggcgtctgggtcatagcccacgagtgcggccaccacgccttcagcgactac

SEQ ID NO: 5525 - DNA, 344 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccaagggtgcgtcctaaccggcgtctgggtcatagcccacgagtgcggccaccacgccttcagcgactac

SEQ ID NO: 5526 - DNA, 340 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctactgggcctgccagggctgcgtcctaaccggcgtctgggtcatagcccacgagtgcggccaccacgccttcagcgactac

SEQ ID NO: 5527 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatcgcctcctgcttctactacgtcgccaccacttacttccctctcctccctcaccctctctcctacttctggcctctctactgggcctgccagggctgcgtcctaaccggcctctgggtcatagcccacgagtgcggccaccacgccttcagcgactac

SEQ ID NO: 5528 - DNA, 349 bp, Artificial
  Mutation in BnaA.FAD2.a introduced by TALE nuclease pair BnFAD2_T01
caggatccatgggtgcaggtggaagaatgcaagtgtcttctccctccaaaaagtctgaaaccgacaacatcaagcgcgtaccctgcgagacaccgcccttaactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctctctactgggcctgccaaggctgcgtcctaacgggcctctgggtcatagcccacgagtgcggccaccacgccttcagcgactac

SEQ ID NO: 5529 - DNA, 348 bp, Artificial
  Mutation in BnaA.FAD2.a introduced by TALE nuclease pair BnFAD2_T01
caggatccatgggtgcaggtggaagaatgcaagtgtatcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggtctctctactgggcctgccagggctgcgtcctaaccggcgtctgggtcatagcccacgagtgcggccaccacgccttcagcgactac

SEQ ID NO: 5530 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgagtgcggccaccacgccttcagcgactac

SEQ ID NO: 5531 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 5532 - DNA, 342 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccagggctgcgtcctaaccggcgtctgggtcatagcccacgagtgcggccaccacgccttcagcgactac

SEQ ID NO: 5533 - DNA, 348 bp, Artificial
  Mutation in BnaA.FAD2.a introduced by TALE nuclease pair BnFAD2_T01
catgatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 5534 - DNA, 344 bp, Artificial
  Mutation in BnaA.FAD2.a introduced by TALE nuclease pair BnFAD2_T01
caggatccatgggtgcaggtggcagaatgcaagtgtctcctccctccaagaagtcttaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatcctctctactgggcctgccagggctgcgtcctaaccggcgtctgggtcatagcccacgagtgcggccaccacgccttcagcgactac

SEQ ID NO: 5535 - DNA, 344 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccggcctctctactgggcctgccagggctgcgtcctaaccggcgtctgggtcatagcccacgagtgcggccaccacgccttcagcgactac

SEQ ID NO: 5536 - DNA, 348 bp, Artificial
  Mutation in BnaA.FAD2.a introduced by TALE nuclease pair BnFAD2_T01
caggatccatgggtgcaggtggcagaatgcaagtgtatccaccctccaagaagtctgaaaccgacaccatcaagcgagtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcttcctaacgggcctctgtgtcatagcccacgagtgctgccacctcgcctgcattgactac

SEQ ID NO: 5537 - DNA, 342 bp, Artificial
  Mutation in BnaA.FAD2.a introduced by TALE nuclease pair BnFAD2_T01
caggatccatgggtgcaggtggcagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccagggctgcgtcctaaccggcgtctgggtcatagcccacgagtgcggccaccacgccttcagcgactac

SEQ ID NO: 5538 - DNA, 340 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctgccagggctgcgtcctaaccggcgtctgggtcatagcccacgagtgcggccaccacgccttcagcgactac

SEQ ID NO: 5539 - DNA, 347 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgacccctcgctctttctcctacctcatctgggacatcatcatagcctcctgcttctactacgtcgccaccacttacttccctctcctccctcaccctctctcctactcgcctctctactgggcctgccagggctgcgtcctaaccggcgtctgggtcatagcccacgagtgcggccaccacgccttcagcgactac

SEQ ID NO: 5540 - DNA, 347 bp, Artificial
  Mutation in BnaA.FAD2.a introduced by TALE nuclease pair BnFAD2_T01
caggatccatgggtgcaggaggaagaatgcaagtgtatcatccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaaggctgcgtcctaacgggcctctgggtcatcgcccacgaatgcggccaccacgccttcagcgactac

SEQ ID NO: 5541 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccagggctgcttcctaacgggcctctgggtcatcgcccacgaatgcggccaccacgcctgcagcgactac

SEQ ID NO: 5542 - DNA, 334 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagacctcaagaaagcaatcccaccgcactgtttcaaacgctcgatccctcgctctttctcctacctcatctgggacatcatcatagcctcctgcttctactacgtcgccaccacttacttccctctcctccctcacccactctctactgggcctgccagggctgcgtcctaaccggcgtctgggtcatagcccacgagtgcggccaccacgccttcagcgactac

SEQ ID NO: 5543 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaaccggcgtctgggtcatagcccactagtgcggccacctcgccttcagcgactac

SEQ ID NO: 5544 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcttgccagggctgcgtcctaaccggcgtctgggtcatagcccacgagtgcggccaccacgccttcagcgactac

SEQ ID NO: 5545 - DNA, 350 bp, Artificial
  Mutation in BnaA.FAD2.a introduced by TALE nuclease pair BnFAD2_T01
caggatccatgggtgcaggtggcagaatgcaagtgtatactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctatcctccctcaccctctctcctacttctggcctctctactgggcctgccagggctgcgtcctaaccggcgtctgggtcatagcccacgagtgcggccaccacgccttcagcgactac

SEQ ID NO: 5546 - DNA, 340 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttactgggcctgccagggctgcgtcctaaccggcgtctgggtcatagcccacgagtgcggccaccacgccttcagcgactac

SEQ ID NO: 5547 - DNA, 332 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccagggctgcgtcctaaccggcgtctgggtcatagcccacgagtgcggccaccacgccttcagcgactac

SEQ ID NO: 5548 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccagggctgcgtcctaaccggcgtctgggtcatagcccacgagtgctgccaccacgccttcagcgactac

SEQ ID NO: 5549 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggacaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 5550 - DNA, 343 bp, Artificial
  Mutation in BnaA.FAD2.a introduced by TALE nuclease pair BnFAD2_T01
caggatccatgggtgcaggtggaagaatgcaagtgcctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccaagggtgcgtcctaaccggcgtctgggtcatagcccacgagtgcggccaccacgccttcagcgactac

SEQ ID NO: 5551 - DNA, 439 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggtccagcgcctgcttgccgccaccgtggctggcgatggccaccgcctgctccggggtcaagccgtgggcctggcacagcaccggcaagcaggcgctgtctctactgggcctgccagggctgcgtcctaaccggcgtctgggtcatagcccacgagtgcggccaccacgccttcagcgactac

SEQ ID NO: 5552 - DNA, 332 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccagggctgcgtcctaaccggcgtcttgggcatagcccacgagtgcggccaccacgcctgcagcgactac

SEQ ID NO: 5553 - DNA, 348 bp, Artificial
  Mutation in BnaA.FAD2.a introduced by TALE nuclease pair BnFAD2_T01
caggatccatgggtgcaggtggaagaatgcaagtgtctcctccccccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 5554 - DNA, 354 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccttggcctctctactgggcctgccaagggtgcgtcctaaccggcgtctgggtcatagcccacgagtgcggccaccacgccttcagcgactac

SEQ ID NO: 5555 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttccctctctactgggcctgccagggctgcgtcctaaccggcgtctgggtcatagcccacgagtgcggccaccacgccttcagcgactac

SEQ ID NO: 5556 - DNA, 324 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcttgccaagggtgcgtcctaaccggcgtctgggtcatagcccacgagtgcgtccaccacgccttcagcgactac

SEQ ID NO: 5557 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctccttctcctacctcatctgggacatcatcatagcctcctgcttctactacgtcgccaccacttacttccctctcctccctcaccctctctcctagcctctctactgggcctgccaagggtgcgtcctaaccggtgtctgggtcatagcccacgagtgcggccaccacgccttcagcgactac

SEQ ID NO: 5558 - DNA, 345 bp, Artificial
  Mutation in BnaA.FAD2.a introduced by TALE nuclease pair BnFAD2_T01
caggatccatgggtgcaggtggcagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctaggcctctctactgggcctgccagggctgcgtcctaaccggcgtcggggtcatagcccacgagtgcggccaccacgccttcagcgactac

SEQ ID NO: 5559 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagggcggccaccacgcctgcagcgactac

SEQ ID NO: 5560 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctaccacctctccacagcctacttccctctcctcccccaccctctcccttaccttggcccctctactgggcctgccaaggctgcgtcctaaccggcgtctgggtcatagcccacgagtgcggccaccacgccttcagcgactac

SEQ ID NO: 5561 - DNA, 358 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctatcctacttcgccgggtctggcctctctactaggcctgccagggctgcgtcctaaccggcgtctgggtcatagcccacgagtgcggccaccacgccttcagcgactac

SEQ ID NO: 5562 - DNA, 348 bp, Artificial
  Mutation in BnaA.FAD2.a introduced by TALE nuclease pair BnFAD2_T01
caggatccatgggtgcaggtcgaagaatgcaagtgtcttctccaccccaaaagtctgaaaccgacacaatccagcgcgtaccctgcgagacaccgcccttcactgtcggagaactcaagaaagcaatcccaccgcactgtttcaaactctcgatccctcgctctttctcctacctcatctgggacatcatcatagcctcctgcttctactacgtcgccaccactaacttccctctcctccctcaccctctctcccacgtagcctctctactgagcctgccagggctgcctcctaaccggcggctggggcatagcccacgagggccgccaccgcgccttctgggactac

SEQ ID NO: 5563 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtagccaccacttacttccctctcctccctcaccctctctcctacttcctggcctctctactgggcctgccagggctgcgtcctaaccggcgtctgggtcatagcccacgagtgcggccaccacgccagcagcgactac

SEQ ID NO: 5564 - DNA, 348 bp, Artificial
  Mutation in BnaA.FAD2.a introduced by TALE nuclease pair BnFAD2_T01
caggatccatgggtgcaggtggcagaatgcaagtgtcacctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgtggccaccacgccttcagcgactac

SEQ ID NO: 5565 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccatcgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 5566 - DNA, 345 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccctggcctctctactgggcctgccagggctgcgtcctaaccggcgtctgggtcatagcccacgagtgcggccaccacgccttcagcgactac

SEQ ID NO: 5567 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctggcctctctactgggcctgccaagggtgcgtcctaaccggcgtctgggtcatagcccacgagtgcggccaccacgccttcagcgactac

SEQ ID NO: 5568 - DNA, 352 bp, Artificial
  Mutation in BnaA.FAD2.a introduced by TALE nuclease pair BnFAD2_T01
caggatccatgggtgcaggtggaagaatgcaagtgtatcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccgccctggcctctctactgggcctgccagggctgcgtcctaacgggcctctgggtcatagcccacgagtgcggccaccacgccttcagcgactac

SEQ ID NO: 5569 - DNA, 332 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcagcccctctactgggcctgccaaggctgcgtcctaacgggcctctgggtcatcgcccacgaatgcggccaccacgccttcagcgactac

SEQ ID NO: 5570 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagagtgcgtcctaaccggcgtctgggtcatagcccacgagtgcggccaccacgccttcagcgactac

SEQ ID NO: 5571 - DNA, 341 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttactgggcctgccagggctgcgtcctaaccggcgtcggggtcatagcccacgagtgcggccaccacgcctgcagcgactac

SEQ ID NO: 5572 - DNA, 342 bp, Artificial
  Mutation in BnaA.FAD2.a introduced by TALE nuclease pair BnFAD2_T01
caggtccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccagggctgcgtcctaaccggcgtctgggtcatagcccacgagtgcggccaccacgccttcagcgactcc

SEQ ID NO: 5573 - DNA, 329 bp, Artificial
  Mutation in BnaA.FAD2.a introduced by TALE nuclease pair BnFAD2_T01
caggatccatgggtgcaggtggcagaatgcaagtgtctcctccatccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgggcctgccagggctgcgtcctaaccggcgtctgggtcatagcccacgagtgcggccaccacgccttcagcgactac

SEQ ID NO: 5574 - DNA, 343 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccagggctgcgtcctaaccggcgtctgggtcatagcccacgagtgcggccaccacgccttcagcgactac

SEQ ID NO: 5575 - DNA, 334 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccaagggtgcgtcctaaccggcgtctgggtcatagcccacgagtgcggccaccacgccatcagcgactac

SEQ ID NO: 5576 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccagggctgcgtcctaaccggcgtctgggtcatcgcccacgaatgcggccaccacgccttcagcgactac

SEQ ID NO: 5577 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctccgacctcatctgggacatcatcatagcctcctgcttctactacgtcgccaccacttacttccctctcctccctcaccctctctcctacttcgctggcctctctactgggcctgccaagggtgcgtcctaaccggcgtctgggtcatagcccacgagtgcggccaccacgccttcagcgactac

SEQ ID NO: 5578 - DNA, 357 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgcgcgcctggcctctctactgggcctgccagggctgcgtcctaaccggcgtctgggtcatagcccacgagtgcggccaccacgccttcagcgactac

SEQ ID NO: 5579 - DNA, 346 bp, Artificial
  Mutation in BnaA.FAD2.a introduced by TALE nuclease pair BnFAD2_T01
caggatccatgggtgcaggcggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccagggctgcgtcctaaccggcgtctggttcatagcccacgagtgcggccaccacgtctgcagcgactac

SEQ ID NO: 5580 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcacagcctcctgcttctactacgtcgccaccacttacttccctctcctccctcaccctctctcctacttcgcccctggcctctctactgggcctgccaagggtgcgtcctaaccggcgtctgggtcatagcccacgagtgcggccaccacgccttcagcgactac

SEQ ID NO: 5581 - DNA, 378 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctccagcgcctgcttgccgccatcgtggctggcgatggccaccacctgctccggggtcaagccgtgagggctgggtcatagcccacgagtgcggccaccacgccttcggcgactac

SEQ ID NO: 5582 - DNA, 339 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttactgggcctgccagggctgcgtcctaaccggcgtctgggtcatagcccacgagtgcggccaccacgccatcagcgactac

SEQ ID NO: 5583 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccagggctgcgtcctaaccggcgtctgggtcatagcccacgagtgcggccaccacgccttcagcgactac

SEQ ID NO: 5584 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaacgggcctctgggtcatcgcccacgagtgcggccaccacgccttcagcgactac

SEQ ID NO: 5585 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctggcctctctactgggcctgccagggctgcgtcctaaccggcgtctgggtcatagcccacgagtgcggccaccacgccttcagcgactac

SEQ ID NO: 5586 - DNA, 424 bp, Artificial
  Mutation in BnaA.FAD2.a introduced by TALE nuclease pair BnFAD2_T01
caggatccatgggtgcaggtggaagaatgcaagtgtctcctccctccaaaaagtcttaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgtgccaggcccacggcttgaccccggagcaggtggtggccatcgccagccacgatggcggcaagcaggcgctggactggcctctctactgggcctgccagggctgcgtcctaaccggcgtctgggtcatagcccacgagtgcggccaccacgccttcagcgactac

SEQ ID NO: 5587 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctctatccctcgctctttctcctacctcatctgggacatcatcatagcctcctgcttctactacgtcgccaccacttacttccctctcctccctcaccctctctcctaggcctctctactgggcctgccagggctgcgtcctaaccggcgtctgggtcatagcccacgagtgcggccaccacgccttcagcgactac

SEQ ID NO: 5588 - DNA, 350 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaacgggcctctgggtcatagcccacgagtgcggccaccacgccttcagcgactac

SEQ ID NO: 5589 - DNA, 349 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctttggcctctctactgggcctgccagggctgcgtcctaaccggcgtctgggtcatagcccacgagtgcggccaccacgccttcagcgactac

SEQ ID NO: 5590 - DNA, 408 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgagccgaagtttccaaaaggtcgttgatcaaagctcgccgcgttgtttcatcaagccttggcctctctactgggcctgccaagggtgcttcctaaccggcgcctgtgtgtgagcccaccagtgcggccaccacgccttcagcgactac

SEQ ID NO: 5591 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctggcctctctactgggcctgccggggctgcgtcctaacgggcctctgggtcatcgcccacgaatgcggccaccacgccttcagcgactac

SEQ ID NO: 5592 - DNA, 348 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 5593 - DNA, 346 bp, Artificial
  Mutation in BnaA.FAD2.a introduced by TALE nuclease pair BnFAD2_T01
caggatccatgggtgcaggtggaagaatgcaagtctctactccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccatggctgcggcctaaccggcgtctgggtcatagctcgcgagtgcgtcctccacgccttcagcgactac

SEQ ID NO: 5594 - DNA, 343 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccagggctgcgtcctaaccggcgtctgggtcatagcccacgagtgcggccaccacgccttcagcgactac

SEQ ID NO: 5595 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctcctctctactgggcctgccaagggtgcgtcctaacgggcctctgggtcatcgcccacgaatgcggccaccacgccttcagcgactac

SEQ ID NO: 5596 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctaatctgggacatcatcatagcctcctgcttctactacgtcgccaccacttacttccctctcctccctcaccctctctcctatctctactgggcctgccaagggtgcgtcctaaccggcgtctgggtcatagcccacgagtgcggccaccacgccttcagcgactac

SEQ ID NO: 5597 - DNA, 343 bp, Artificial
  Mutation in BnaA.FAD2.a introduced by TALE nuclease pair BnFAD2_T01
caggatccatgtgtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccagggctgcgtcctaaccggcgtctgggtcatagcccacgagtgcggccaccacgccttcagcgactac

SEQ ID NO: 5598 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgcctggcctctctactgggcctgccaagggtgcgtcctaaccggcgtctgggtcatagcccacgagtgcggccaccacgccttcagcgactac

SEQ ID NO: 5599 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctctttctcctacctcatctgggacatcatcatagcctcctgcttctactacgtcgccaccacttacttccctctcctccctcaccctctctcctactttggcctctctactgggcctgccagggctgcgtcctaacgggcgtctgggtcatagcccacgagtgcggccaccacgccttcagcgactac

SEQ ID NO: 5600 - DNA, 300 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtctctctactgggcctgccaagggtgcgtcctaacgggcctctgggtcatagcccacgagtgcggccaccacgccttcagcgactac

SEQ ID NO: 5601 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccagggctgcgtcctaacgggcctctgggtcatcgcccacgaatgcggccaccacgccttcagcgactac

SEQ ID NO: 5602 - DNA, 338 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctctctactgggcctgccaagggtgcgtcctaaccggcgtctgggtcatagcccacgagtgcggccaccacgcctgcagcgactac

SEQ ID NO: 5603 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctacgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 5604 - DNA, 342 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcgctgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccagggctgcgtcctaaccggcgtctgggtcatagcccacgagtgcggccaccacgccttcagcgactac

SEQ ID NO: 5605 - DNA, 347 bp, Artificial
  Mutation in BnaA.FAD2.a introduced by TALE nuclease pair BnFAD2_T01
caggatccatgggtgcaggcggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccagggctgcgtcctaaccggcgtctgggtcatagcccacgagtgcggccaccacgtcttcagcgactac

SEQ ID NO: 5606 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccccccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctactcctctctactgggcctgccaagggtgcgtcctaacgggcctctgggtcatcgcccacgaatgcggccaccacgcctgcagcgactac

SEQ ID NO: 5607 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccaagggtgtgtcctaaccggcgtctgggtcatagcccacgagtgcggccaccacgccttcagcgactac

SEQ ID NO: 5608 - DNA, 345 bp, Artificial
  Mutation in BnaA.FAD2.a introduced by TALE nuclease pair BnFAD2_T01
caggatccatgggtgcaggtggaagaatgcaagtctctcctccctccaagacgtctgaaaccgacaccatcaagcgcgtcccctgcgagacaccgcccttcactgtcggagaactcaagaaagcaatcccaccgcactgtttcaaacgctcgatccctcgctctttctcctacctcatctgggacatcatcatctcctcctgcttctactacgtctccaccacttacttccctctcctccctcaccctctccccctggcctctctactgggcctgccagggctgcgtcctaaccggcgtctgggtcatagcccacgagtgcggccaccacgccttcagcgactac

SEQ ID NO: 5609 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccgcctggcctctctactgggcctgccagggctgcgtcctaaccggcgtctgggtcatagcccacgagtgcggccaccacgccttcagcgactac

SEQ ID NO: 5610 - DNA, 357 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccggtttgcgtattgccggtgcctggcctctctactgggcctgccagggctgcgtcctaaccggcgtctgggtcatagcccacgagtgcggccaccacgccttcagcgactac

SEQ ID NO: 5611 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaacctgcgagacaccgcccttcactgtcggagaactcaagaaagcaatcccactgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 5612 - DNA, 356 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgctaccacttacttccctctcctccctcaccctctctcctacttcgccgcctggcctctctactgggcctgccagggctgcgtcctaaccggcgtctgggtcatagcccacgagtgcggccaccacgccttcagcgactac

SEQ ID NO: 5613 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgacttcggccaccacgccttcagcgactac

SEQ ID NO: 5614 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgggcctctctactgggcctgccaaggctgcgtcctaacgggcctctgggtcagagcccacgagggcggccaccactccttcagcgactac

SEQ ID NO: 5615 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctagctctttctcctacctcatctgggacatcatcatagcctcctgcttctactacgtcgccaccacttacttccctctcctccctcaccctctctcctatggcctctctactgggcctgccagggctgcgtcctaaccggcgtctgggtcatagcccacgagtgcggccaccacgccttcagcgactac

SEQ ID NO: 5616 - DNA, 338 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattactgggcctgccagggctgcgtcctaaccggcgtctgggtcatagcccacgattgcggccaccacgccttgagcgactac

SEQ ID NO: 5617 - DNA, 334 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccagggctgcgtcctaaccggcgtctgggtcatagcccacgagtgcggccaccacgccttcagcgactac

SEQ ID NO: 5618 - DNA, 340 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttactgggcctgccagggctgcgtcctaacgggcctctgggtcatcgcccacgaatgcggccaccacgccttcagcgactac

SEQ ID NO: 5619 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccccttcgcccctggcctctctactgggcctgccaagggtgcgtcctaaccggcgtctgggtcatagcccacgagtgcggccaccacgccttcagcgactac

SEQ ID NO: 5620 - DNA, 455 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgctggcccgtccccagcgcctgctgcccgccatcgtggctggcgatggccaccacctgctccggggtcaggccgtgggcctggcacagcaccggcaacagccgcttggcctctctactgggcctgccagggctgcgtcctaaccggcgtctgggtcatagcccacgagtgcggccaccacgccttcagcgactac

SEQ ID NO: 5621 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcctctgggacatcatcatagcctcctgcttctactacgtcgccaccacttacttccctctcctccctcaccctctctcctacttcctggcctctctactgggcctgccagggctgcgtcctaaccggcgtctgggtcatagcccacgagtgcggccaccacgccttcagcgactac

SEQ ID NO: 5622 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagagcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 5623 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgacagggctgcgtcctaaccggcgtctgggtcatagcccacgagtgcggccaccacgccttcagcgactcc

SEQ ID NO: 5624 - DNA, 350 bp, Artificial
  Mutation in BnaA.FAD2.a introduced by TALE nuclease pair BnFAD2_T01
caggatccatgggtgcaggtggaagaatgcaagtgtctcctccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatcgcccacgaatgcggccaccacgccttcagcgactac

SEQ ID NO: 5625 - DNA, 339 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctccttcctcaccctctctcctctctactgggcctgccagggctgcggcctaaccggcgtctgggtcatagcccaccagtgcggccaccacgcctgcagcgaccac

SEQ ID NO: 5626 - DNA, 348 bp, Artificial
  Mutation in BnaA.FAD2.a introduced by TALE nuclease pair BnFAD2_T01
caggatccatgggtgcaggtggaagaatgcaagtgtctaatccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccatggctgcggcctaaccggcgtctgggtcatagcccacgagtgcggccaccacgccttcagcgactac

SEQ ID NO: 5627 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttctggcctctctactgggcctgccagggctgcgtcctaaccggcgtctgggtcatagcccacgagtgcggccaccacgcctgcagcgactac

SEQ ID NO: 5628 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctacggggcctgccaagggtgcggcctaaccggcgtctgggtcatagcccacgagtgcggccaccacgccttcctcgactac

SEQ ID NO: 5629 - DNA, 341 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctccctctctcctacctctctactgggcctgccaagggtgcgtcctaaccggcgtctgggtcatagcccacgagtgcggccaccacgccttcagcgactac

SEQ ID NO: 5630 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgctggcctctctactgggcctgccagggctgcgtcctaaccggcgtctgggtcatagcccacgagtgcggccaccacgccttcagcgactac

SEQ ID NO: 5631 - DNA, 345 bp, Artificial
  Mutation in BnaA.FAD2.a introduced by TALE nuclease pair BnFAD2_T01
caggatccatgggtgcaggtggaagaatgcgagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccagggctgcgtcctaaccggcgtctgggtcatagcccacgagtgcggccaccacgccttcagcgactac

SEQ ID NO: 5632 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaaggctgcgtcctaacgggcctctgggtcatcgcccacgaatgcggccaccacgccttcagcgactac

SEQ ID NO: 5633 - DNA, 329 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgggcctgccagggctgcgtcctaaccggcgtctgggtcatagcccacgagtgcggccaccacgcctgcagcgactac

SEQ ID NO: 5634 - DNA, 344 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccagggctgcgtcctaaccggcgtctgggtcatagcccacgagtgcggccaccacgccttcagcgactac

SEQ ID NO: 5635 - DNA, 325 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggctgcgtcctaaccggcgtctgggtcatagcccacgagtgcggccaccacgcctgcagcgactac

SEQ ID NO: 5636 - DNA, 346 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccaagggtgcgtcctaaccggcgtctgggtcatagcccacgagtgcggccaccacgccttcagcgactac

SEQ ID NO: 5637 - DNA, 398 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgccaacttctcaagattgcaaaacgtggcggcgtgaccgcagtggaggcagtgcatgcgcctctctactgggcctgccaaggctgcgtcctaacgggcctctgggtcatcgcccacgaatgcggccaccacgccttcagcgactac

SEQ ID NO: 5638 - DNA, 353 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgcttcaaacgctccatcccacgctccttctcctcttcgacatcatcatctcctcctcggctcctccctctaccacctctccacagcctacttccctctcctccctctccctctctcctcctccgctggcctctctactgggcctgccagggctgcgtcctaaccggcgtctgggtcatagcccacgagtgcggccaccacgccttcagcgactac

SEQ ID NO: 5639 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccaagggtgcgtcctaaccggcgtctgggtcatagcccacgagtgcggccaccacgcctgcagcgactac

SEQ ID NO: 5640 - DNA, 348 bp, Artificial
  Mutation in BnaA.FAD2.a introduced by TALE nuclease pair BnFAD2_T01
caggatccatgggtgcaggtggaagaatgcaagtgtctcctcccttccagaagtctgaaaccgacaccatcaagcgcgtaccctgtgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaacctgcgtctgggtcatagcgcacgagtgcggccaccacgccatcagcgactac

SEQ ID NO: 5641 - DNA, 421 bp, Artificial
  Mutation in BnaA.FAD2.a introduced by TALE nuclease pair BnFAD2_T01
caggatccatgggtgcaggcggaagaatgcaagtgtctcctccctccaagaagtctgaaaccgacaacatcaagcgcgtaccctgtgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgccaggcatcaaataaaacgaaaggctcagtctcggtcgttcggctgcggcgagcggtatcagctcactcaaagcctggcctctctactgggcctgccagggctgcgtcctaaccggcgtctgggtcatagcccacgagtgtggccaccacgcctgcagcgactac

SEQ ID NO: 5642 - DNA, 342 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccaagggtgcgtcctaaccggcgtctgggtcatagcccacgagtgcggccaccacgccttcagcgactac

SEQ ID NO: 5643 - DNA, 334 bp, Artificial
  Mutation in BnaA.FAD2.a introduced by TALE nuclease pair BnFAD2_T01
caggatccatgggtgcaggtggaagaatgcaagtgcctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccagggctgcgtcctaaccggcgtctgggtcatagcccacgagtgcgtccaccacgccttcagcgactac

SEQ ID NO: 5644 - DNA, 352 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgccctggcctctctactgggcctgccagggctgcgtcctaaccggcgtctgggtcatagcccacgagtgcggccaccacgccatcagcgactgc

SEQ ID NO: 5645 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccccttggcctctctactgggcctgccagggctgcgtcctaaccggcgtctgggtcatagcccacgagtgcggccaccacgccttcagcgactac

SEQ ID NO: 5646 - DNA, 347 bp, Artificial
  Mutation in BnaA.FAD2.a introduced by TALE nuclease pair BnFAD2_T01
caggatccatgggtgcaggtgggagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 5647 - DNA, 348 bp, Artificial
  Mutation in BnaA.FAD2.a introduced by TALE nuclease pair BnFAD2_T01
caggatccatgggtgcaggtggaagaatgcaagtgtctgctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 5648 - DNA, 356 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgtttcaaacgctcgatccctcgctctttctcctacctcatctgggacatcatcatagcctcctgcttctactacgtcgccaccacttacttccctctcctccctcaccctctctcctacttcgacgcctggcctctctactgggcctgccaagggtgcgtcctaaccggcgtctgggtcatagcccacgagtgcggccaccacgccttcagcgactac

SEQ ID NO: 5649 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgcctgggtcatagcccacgagtgcggccaccacgccttcagcgactac

SEQ ID NO: 5650 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctctcctactttggcctctctactgggcctgccaagggtgcgtcctaaccggcgtctgggtcatagcccacgagtgcggccaccacgccttcagcgactac

SEQ ID NO: 5651 - DNA, 357 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccggtttgcgtattgccggtgcctggcctctctactgggccagccaagggtgcgtcctaaccggcgtctgggtcatagcccacgagtgcggccaccacgccttcagcgactac

SEQ ID NO: 5652 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccagggctgcgtcctaacgggcctctgggtcatagcccacgagtgcggccaccacgcctgcagcgactac

SEQ ID NO: 5653 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccccaacttctctctactgggcctgccaaggctgcgtcctaacgggcctctggttcatagcccacgagtgcggccaccacgccttcagcgactac

SEQ ID NO: 5654 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagggcggccaccacgcctgcagcgactac

SEQ ID NO: 5655 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggcctgccaaggctgcgtcctaacgggcctctgggtcatagcccacgagtgcggccaccacgccttcagcgactac

SEQ ID NO: 5656 - DNA, 339 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttacttggcctgccagggctgcgtcctaaccggcgtctgggtcatagcccacgagtgcggccaccacgccttcagcgactac

SEQ ID NO: 5657 - DNA, 354 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgccctgacccctctactgggcctgccaaggctgcgtcctaacgggcctctgggtcatagcccacgagtgcggccaccacgccttcagcgactac

SEQ ID NO: 5658 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccagggctgcgtcctaacgggcctctgggtcatagcccacgagtgcggccaccacgccttcagcgactac

SEQ ID NO: 5659 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcggcctaaccggcgtctgggtcatagcccacgagtgcggccaccacgccttcagcgactac

SEQ ID NO: 5660 - DNA, 378 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctccagcgcctgcttgccgccatcgtggctggcgatggccaccacctgctccggggtcaagccgtgagggctgggtcatagcccacgagtgcggccaccacgcctgcagcgactac

SEQ ID NO: 5661 - DNA, 419 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctccttcttctactacgtcgccaccacttacttccctctcctccctcaccctctctcctactaagactgggcctttcgttttatctgttgtttgtcggtgaacgctctcctgagtaggacaaatccgctcccttggcttttttactgggcctgccaagggtgcgtcctaaccggcgtctgggtcatagcccacgagtgcggccaccacgccttcagcgactac

SEQ ID NO: 5662 - DNA, 356 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaaggctgcgtcctaacgggcctctgggtcatagcccacgagtgcggccaccacgccttcagcgactac

SEQ ID NO: 5663 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgaatgcggccaccacgccttcagcgactac

SEQ ID NO: 5664 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccagggctgcgtcctaaccggcgtctgggtcatagctcacgagtgcggccaccacgccttcagcgactac

SEQ ID NO: 5665 - DNA, 332 bp, Artificial
  Mutation in BnaA.FAD2.a introduced by TALE nuclease pair BnFAD2_T01
caggatccatgggtgcaggtggaagaatgtaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccaagggtgcgtcctaaccggcgtctgggtcatagcccacgagtgcggccaccacgccttcagcgactac

SEQ ID NO: 5666 - DNA, 345 bp, Artificial
  Mutation in BnaA.FAD2.a introduced by TALE nuclease pair BnFAD2_T01
catgatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggcctgccagggctgcgtcctaaccggcgtctgggtcatagcccacgagtgcggccaccacgccttcagcgactac

SEQ ID NO: 5667 - DNA, 328 bp, Artificial
  Mutation in BnaA.FAD2.a introduced by TALE nuclease pair BnFAD2_T01
caggatccatgggtgcaggcggaagaatgcaagtgtctcctcaatacaaaaagtctgaaaccgacaacatcaagcgcgtaccctgcgagacaccgcccttcactgtcggagaactcaagaaagcaatcccaccgcactgtttcaaacactcgatccctcgctctttctcctacctcatctgggacatcatcatagcctcctgcttctactacgtcgccaccacttacttccctctccgccctcaccctctctgggcctgccagggcttcgtccaaaccggcgtctgggtcataccccacgagttctgccaccactccttcacgactac

SEQ ID NO: 5668 - DNA, 323 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctcgagccacccactgggcctgccagggctgcgtcctaaccggcgtctgggtcatagcccacgagtgcggccaccacgccgtcagcgactac

SEQ ID NO: 5669 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctccttcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 5670 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtaggagaactcaagaaagcaatcccaccgcactgtttcaaacgctcgatccctcgctctttctcctacctcatctgggacatcatcatagcctcctgcttctactacgtcgccaccacttacttccctctcctccctcaccccctctcctacttgcctctctactgggcctgccaagggtgcgtcctaaccggcgtctgggtcatagcccacgagtgcggccaccacgcctgcagcgactac

SEQ ID NO: 5671 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctctctactgggcctgccagggctgcgtcctaacgggcctctgggtcatcgcccacgaatgcggccaccacgccttcagcgactac

SEQ ID NO: 5672 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccatcgcactgtttcaaacgctcgatccctcgccctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 5673 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctatcctccctcaccctctctcctaccgcgcggcctctctactgggcctgccagggctgcgtcctaaccggcgtctgggtcatagcccacgagtgcggccaccacgccttcagcgactac

SEQ ID NO: 5674 - DNA, 343 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcaggcctctctactgggcctgccaagggtgcgtcctaaccggcgtctgggtcatcgcgcacgaatgcggccaccacgcctgtagcgactac

SEQ ID NO: 5675 - DNA, 424 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccaacaacatcaagcgcgtaccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctcccctgcttctccagcgcctgcttgccgccatcgtggctggcgctggccaccacctgctggggggtcaagccgtgggcctggcatggcctctctactgggcctgccaagggtgcgtcctaaccggcgtctgggtcatagcccacgagtgcggccaccacgcctgcagcgactac

SEQ ID NO: 5676 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcatacttctggcctctctactgggcctgccagggctgcgtcctaaccggcgtctgggtcatagcccacgagtgcggccaccacgccttcagcgactac

SEQ ID NO: 5677 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccgttggcctctctactgggcctgccaagggtgcgtcctaaccggcgtctgggtcatagcccacgaatgcggccaccacgccttcagcgactac

SEQ ID NO: 5678 - DNA, 341 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctactgggcctgccagggctgcgtcctaaccggcgtctgggtcatagcccacgagtgcggccaccacgccttcagcgactac

SEQ ID NO: 5679 - DNA, 356 bp, Artificial
  Mutation in BnaA.FAD2.a introduced by TALE nuclease pair BnFAD2_T01
caggatccatgggtgcagatggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccagggctgcgtcctaaccggcgtctgggtcatagcccacgagtgcggccaccacgccttcagcgactac

SEQ ID NO: 5680 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatcactcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgcctgcagcgactac

SEQ ID NO: 5681 - DNA, 354 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgccggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttccgcctggcctctctactgggcctgccaagggtgcgtcctaaccggcgtctgggtcatagcccacgagtgcggccaccacgccttcagcgactac

SEQ ID NO: 5682 - DNA, 345 bp, Artificial
  Mutation in BnaA.FAD2.a introduced by TALE nuclease pair BnFAD2_T01
caggatccatgggtgcaggtggaagaatgcaagtttctcctccctccaaaaagtctcaaaccgacaccatcaagcgcgtaccctgcgagacaccgcccttcactgtcggacaactcaagaaagcaatcccaccgcactgtttaaaacgctcgatccctcgctctttctccgacctcatctgggacatcatcatagcctcctgcttctactacgtcgccaccacttacttccctctcctccctcaccctctccccgtggcctctctactgggcctgccatggctgcttccgaacccgcgtctgggtcatagcccacgagtgctgccaccacgccatcagcgactac

SEQ ID NO: 5683 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaacgggcctctgggtcatagcccacgagtgcggccaccacgccttcagcgactac

SEQ ID NO: 5684 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaacctacaacatcaaactcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggcctgccagggctgcgtcctaaccggcgtctgggtcatagcccacgagtgcggccaccacgccttcagcgactac

SEQ ID NO: 5685 - DNA, 347 bp, Artificial
  Mutation in BnaA.FAD2.a introduced by TALE nuclease pair BnFAD2_T01
caggatccatgggtgcaggtggaagaatgcaagtgtctcctccatccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccagggctgcgtcctaaccggcgtctgggtcacagcccacgagtgcggccaccacgcctgcagcgactac

SEQ ID NO: 5686 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctactgggcctgccagggctgcgtcctaaccggcgtctgggtcatagcccacgaatgcggccaccacgccttcagcgactac

SEQ ID NO: 5687 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgtggcctctctactgggcctgccagggctgcgtcctaaccggcgtctgggtcatagcccacgagtgcggccaccacgccttcagcgactac

SEQ ID NO: 5688 - DNA, 343 bp, Artificial
  Mutation in BnaA.FAD2.a introduced by TALE nuclease pair BnFAD2_T01
caggatccatgggtgcaggtggaagaatgcaagtgtctcctccctcccaaaagtctgaaaccgacaacatcaagcgcgtaccctgcgagacaccgcccttcactgtcgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgctggcctctctactgggcctgccagggctgcgtcctaaccggcgtctgggtcatagcgcacgagtgcggccaccacgccagcagcgactac

SEQ ID NO: 5689 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggaaaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctcgcctctctactgggcctgccagggctgcgtcctaaccggcgtctgggtcatagcccacgagtgcggccaccacgccttcagcgactac

SEQ ID NO: 5690 - DNA, 354 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagaactcaagaaagcaatcccaccgcactgtttcaaacgctcgatccctcgctctttctcctacctcatctgggacatcatcatagcctcctgcttactacgtcgccaccacttacttccctctcctccctcaccctctctcctacttcgccgcctggcctctctactgggcctgccagggctgcgtcctaaccggcgtctgggtcatagcccacgagtgcggccaccacgccttcagcgactac

SEQ ID NO: 5691 - DNA, 277 bp, Artificial
  Mutation in BnaA.FAD2.a introduced by TALE nuclease pair BnFAD2_T01
caggatccatgggtgcaggtggaagaatgcaagtgcctcctccctccaaaaagtctgaaacagacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacgccttcagcgactac

SEQ ID NO: 5692 - DNA, 342 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccaagggtgcgtcctaaccggcgtctgggtcatagcccacgagtgcggccaccacgcctgcagcgactac

SEQ ID NO: 5693 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctaggcctctctactgggcctgccagggctgcgtcctaaccggcgtctgggtcatagcccacgagggcggccaccacgccttcagcgactac

SEQ ID NO: 5694 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggtgtctgggtcatagcccacgagtgcggccaccacgccttcagcgactac

SEQ ID NO: 5695 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcataccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 5696 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctctggcccctctactgggcctgccaaggctgcgtcctaacgggcctctgggtcatcgcccacgaatgcggccaccacgcctgcagcgactac

SEQ ID NO: 5697 - DNA, 414 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccggcaaaatcacgccgaaggatgtcgctgccgactgggcaatggagcgcttgccggcccacctggcctctctactgggcctgccagggctgcgtcctaacgggcctctgggtcatcgcccacgaatgcggccaccacgccttcagcgactac

SEQ ID NO: 5698 - DNA, 378 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctccagcgcctgcttgccgccatcgtggctggcgatggccaccacctgctccggggtcaagccgtgagggctgggtcatagcccacgagtgcggccaccacgccttcagcgactac

SEQ ID NO: 5699 - DNA, 349 bp, Artificial
  Mutation in BnaA.FAD2.a introduced by TALE nuclease pair BnFAD2_T01
caggatccatgggtgcaggtggaagaatgcaagtctctcctccctccaactcgtccgaaaccgacaccatcaaacgcgtaccctgcgagacaccacccttcactctcggagaactcaagaaagcaatcccacctcactgcttcaaacgctcgatccctcgctctttctcctacctcatcttggacatcatcatctcctcctgcttctactacctctccaccacttacttccctctcctccctcaccctctctcctcccccggcctctctactgggcctgccagggctgcgtcctaaccggcgtctgggtcatagcccacgagtgcggccaccacgccttcagcgactac

SEQ ID NO: 5700 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctactgggcctgccggggctgcgtcctaaccggcgtctgggtcatagcccacgagtgcggccaccacgccttcagcgactac

SEQ ID NO: 5701 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctagcctctctactgggcctgccagggctgcgtcctaaccggcgtctgggtcatagcccacgagtgcggccaccacgcctgcagcgactac

SEQ ID NO: 5702 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccaagggtgcgtcctaacgggcctctgggtcatagcccacgagtgcggccaccacgccttcagcgactc

SEQ ID NO: 5703 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacttggcctctctactgggcctgccagggctgcgtcctaacgggcctctgggtcatcgcccacgaatgcggccaccacgccttcagcgactac

SEQ ID NO: 5704 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtggcctctctactgggcctgccagggctgcgtcctaaccggcgtctgggtcatagcccacgagtgcggccaccacgccttcagcgactac

SEQ ID NO: 5705 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaaggctgcgtcctaaccggcgtctgggtcatagcccacgagtgcggccaccacgccttcagcgactac

SEQ ID NO: 5706 - DNA, 358 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctaccctggcctctctactgggcctgccaagggtgcgtcctaaccggcgtctgggtcatagcccacgagtgcggccaccacgccttcagcgactac

SEQ ID NO: 5707 - DNA, 349 bp, Artificial
  Mutation in BnaA.FAD2.a introduced by TALE nuclease pair BnFAD2_T01
caggatccatgggtgcaggtgcaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaaggctgcgtcctaacgggcctctgggtcatcgcccacaaatgcggccaccacgccttcagcgactac

SEQ ID NO: 5708 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccagggctgcgtcctaaccggcgtcttggtcatagcccacgagtgcggccaccacgccttcagcgactac

SEQ ID NO: 5709 - DNA, 351 bp, Artificial
  Mutation in BnaA.FAD2.a introduced by TALE nuclease pair BnFAD2_T01
caggatccatgggtgcaggtggaagaatgcaagtgtctacttacaacaaaaagtctgaaaccgacaacatcaagcgcgtaccctgcgagacaccgcccttcactgtcggacaactcaagaaagcaatcccaccgcactgtttcaaacgctcgatccctcgctctttctcctacctcatctgggacatcatcatagcctcctgcttctactacctcgccaccacttacttccctctcctccctcaccctctctccaccaacggagcctctctactgggcgtgccaaaggcgcggcctaaccgacgtctggcgcatagcccagatgtgcggccaccgcacctgcagcgactac

SEQ ID NO: 5710 - DNA, 351 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccagggctgcgtcctaaccggcgtctgggtcatagcccacgagtgcggccaccacgccttcagcgactac

SEQ ID NO: 5711 - DNA, 344 bp, Artificial
  Mutation in BnaA.FAD2.a introduced by TALE nuclease pair BnFAD2_T01
caggatccatgggtgcaggtggaagaatgcaagtgtctaccccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctcacctccctcaccctctccccgggcctctctactgggcctgccagggctgcgtcctaaccggcgtctgggtcatagcccgcgagtgcggccaccacgccttcagcgactac

SEQ ID NO: 5712 - DNA, 351 bp, Artificial
  Mutation in BnaA.FAD2.a introduced by TALE nuclease pair BnFAD2_T01
caggatcatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccgccctggcctctctactgggcctgccagggctgcgtcctaaccggcgtctgggtcatagcccacgagtgcggccaccacgccttcagcgactac

SEQ ID NO: 5713 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaacctacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 5714 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtctgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaaccggcgtctggttcatagcccacgagggcggccaccacgccttcagcgactac

SEQ ID NO: 5715 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacttgcctctctactgggcctgccagggctgcgtcctaaccggcgtctgggtcatagcccacgagtgcggccaccacgccttcagcgactac

SEQ ID NO: 5716 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgtcagggctgcgtcctaaccggcgtctgggtcatagcccacgagtgcggccaccacgccttcagcgactac

SEQ ID NO: 5717 - DNA, 349 bp, Artificial
  Mutation in BnaA.FAD2.a introduced by TALE nuclease pair BnFAD2_T01
caggatacatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccggcgtctgggtcatagcccacgagtgcggccaccacgccttcagcgactac

SEQ ID NO: 5718 - DNA, 349 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctttcctggcctctctactgggcctgccagggctgcgtcctaaccggcgtctgggtcatagcccacgagtgcggccaccacgccttcagcgactac

SEQ ID NO: 5719 - DNA, 357 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtacactgcgagacaccgcccttcactgtcggagaactcaagaaagcaatcccaccgcactgtttcaaacgctcgatccctcgctctttctcctacctcatctgggacatcatcatagcctcctgcttctactacgtcgccaccatttacttccctctcctccctcaccctctctcctactccgcgcgcctggcctctctactgggcctgccagggctgcgtcctaaccggcgtctgggtcatagcccacgagtgcggccaccacgccttcagcgactac

SEQ ID NO: 5720 - DNA, 356 bp, Artificial
  Mutation in BnaA.FAD2.a introduced by TALE nuclease pair BnFAD2_T01
cagtatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccacgccttcagcgactac

SEQ ID NO: 5721 - DNA, 449 bp, Artificial
  Mutation in BnaA.FAD2.a introduced by TALE nuclease pair BnFAD2_T01
caggatccatgggtgcaggtggcagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgccaggcccacggcttgaccccggagcaggtggtggccatcgccagcaatggcggtggcaagcaggcgctggagacggtccagcggctgttgccggtgctggcctctctactgggcctgccagggctgcgtcctaaccggcctctgggtcatcgcccacgaatgcggccaccacgccttcagcgactac

SEQ ID NO: 5722 - DNA, 335 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccaaggctgcgtcctaacgggcctctgggtcatcgcccacgaatgcggccaccacgccttcagcgactac

SEQ ID NO: 5723 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacttcgcctctctactgggcctgccagggctgcgtcctaaccggcgtctgggtcatagcccacgagtgcggccaccacgccttcagcgactac

SEQ ID NO: 5724 - DNA, 339 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctggcctctctactgggcctgccagggctgcgtcctaaccggcgtctgggtcatagcccacgagtgcggccaccacgccttcagcgactac

SEQ ID NO: 5725 - DNA, 346 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccagggctgcgtcctaaccggcgtctgggtcatagcccacgagtgcggccaccacgccttcagcgactac

SEQ ID NO: 5726 - DNA, 334 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacataaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccaagggtgcgtcctaacgggcctctgggtcatagcccacgagtgcggccaccacgccttcagcgactac

SEQ ID NO: 5727 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgcgacaccgcccttcactgtcggagaactcaagaaagcaatcccaccgcactgtttcaaacgctcgatccctcgctctttctcctacctcatctgggacatcatcatagcctcctgcttctactacgtcgccaccccttacttccctctcctccctcaccctctctcccacctcgcctctctactgggcctgccaagggtgcgtcctaaccggcgtctgggtcagagcccacgagtgcggccaccacgccttcagcgactac

SEQ ID NO: 5728 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctcccccaccctctctcctacttcctctctactgggcctgccagggctgcgtcctaaccggcgtctgggtcatagcccacgagtgcggccaccacgccttcagcgactcc

SEQ ID NO: 5729 - DNA, 277 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacttcgcgccttcagcgactac

SEQ ID NO: 5730 - DNA, 343 bp, Artificial
  Mutation in BnaA.FAD2.a introduced by TALE nuclease pair BnFAD2_T01
caggatccattggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccaagggtgcgtcctaaccggcgtctgggtcatagcccacgagtgcggccaccacgccttcagcgactac

SEQ ID NO: 5731 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttactgggcctgccagggctgcgtcctaaccggcgtctgggtcatagcccaccagtgcggccaccacgccttcagcgcctac

SEQ ID NO: 5732 - DNA, 357 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctactccgcccgcctggcctctctactgggcctgccagggctgcgtcctaaccggcgtctgggtcatatcccacgagtgcggccaccacgccttcagcgactac

SEQ ID NO: 5733 - DNA, 334 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccccgcgagacaccaccattcactctcggagacctcaagaaagcaatcccacctcactgcttcaaacgctccatcccacgctctttctcctacctcatctgggacatcatcatagcctcctgcttctactacgtcgccaccacttacttccctctcctccctcaccctctctctactgggcctgccagggctgcgtcctaaccggcgtctgggtcatagcccacgagtgcggccaccacgccttcagcgactac

SEQ ID NO: 5734 - DNA, 347 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaatggcctctctactgggcctgccagggctgcgtcctaaccggcgtctgggtcatagcccacgagtgcggccaccacgccttcagcgactac

SEQ ID NO: 5735 - DNA, 335 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcctctctactgggcctgccagggctgcgtcctaaccggcgtctgggtcatagcccacgagtgcggccaccacgccttcagcgactac

SEQ ID NO: 5736 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccagggctgcgtcctaaccggcgtctgggtcatagcccacgagtgcggccaccacgccttcagcgactac

SEQ ID NO: 5737 - DNA, 421 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgccaggcatcaaataaaacgaaaggctcagtctcggtcgttcggctgcggcgagcggtatcagctcactcaaagcctggcctctctactgggcctgccagggctgcgtcctaaccggcgtctgggtcatagcccacgagtgcggccaccacgccttcagcgactac

SEQ ID NO: 5738 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatcttggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 5739 - DNA, 345 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccagggctgcgtcctaaccggcgtctgggtcatagcccacgagtgcggccaccacgccttcagcgactac

SEQ ID NO: 5740 - DNA, 409 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcccgccaccctccgggccgttgcttcacaacgttcaaatccgctcccggcggatttgtctggcctctctactgggcctgccagggctgcgtcctaaccggcgtctgggtcatagcccacgagtgcggccaccacgccttcagcgatac

SEQ ID NO: 5741 - DNA, 387 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgccgccatcgtggctggcgatggccaccacctgctcctggcctctctactgggcctgccagggctgcgtcctaaccggcgtctgggtcatagcccacgagtgcggccaccacgccttcagcgactac

SEQ ID NO: 5742 - DNA, 342 bp, Artificial
  Mutation in BnaA.FAD2.a introduced by TALE nuclease pair BnFAD2_T01
caggatccatgggtgcaggtggcagaatgcaagtctctcctccctccagctcccccggaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctctctactgggcctgccagggctgcgtcctaaccggcgtctgggtcatagcccacgagtgcggccaccacgccttcagcgactac

SEQ ID NO: 5743 - DNA, 348 bp, Artificial
  Mutation in BnaA.FAD2.a introduced by TALE nuclease pair BnFAD2_T01
caggatacatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 5744 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggccctctactgggcctgccagggctgcgtcctaaccggcgtctgggtcatagcccacgagtgcggccaccacgccttcagcgactac

SEQ ID NO: 5745 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggcctctctactgggcctgccaaggctgcgtcctaacgggcctctgggtcatcgcccacgaatgcggccaccacgccttcagcgactac

SEQ ID NO: 5746 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacgcctctctactgggcctgccagggctgcgtcctaacgggcctctgggtcatagcccacgagtgcggccaccacgccttcagcgactac

SEQ ID NO: 5747 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctcgggcctctctactgggcctgccagggctgcgtcctaaccggcgtctgggtcatagcccacgagtgcggccaccacgccttcagcgactac

SEQ ID NO: 5748 - DNA, 354 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctttcgcctggcctctctactgggcctgccagggctgcgtcctaaccggcgtctgggtcatagcccacgagtgcggccaccacgccttcagcgactac

SEQ ID NO: 5749 - DNA, 332 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgctagacaccgcccttcactgtcggagaactcaagaaagcaatcccaccgcactgtttcaaacgctcgatcccacgctccttctcctcttcgacatcatcatctcctcctcggctcctccctctaccacctccccacagcctacttccctctcctccctggcccctctactgggcctgccaaggctgcgtcctaacgggcctctgggtcatcgcccacgaatgcggccaccacgccttcagcgactac

SEQ ID NO: 5750 - DNA, 351 bp, Artificial
  Mutation in BnaA.FAD2.a introduced by TALE nuclease pair BnFAD2_T01
caggatccatgggtgcaggtggaagaatgcaagtgtctcctcctccaaaaagtctgaaaccgacaacatcaagcgcgtaccctgcgagacaccgcccttcactgtcggagaactcaagaaagcaatcccaccgcactgtttcaaaggctcgatccctcgctctttctcctacctcatctgggacatcatcatagcctcctgcttctactacgtcgccaccacttacttccctctcctccctcaccctctctcctacttcgctggcctctctactgggcctgccaaggctgcgtcctaacgggcctctgggtcatcgcccacgaatgcggccaccacgccttcagcgactac

SEQ ID NO: 5751 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctttggcctctctactgggcctgccaagggtgcgtcctaaccggcgtctgggtcatagcccacgagtgcggccaccacgccttcagcgactac

SEQ ID NO: 5752 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcctctctactgggcctgccaagggtgcgtcctaaccggcgtctgggtcatagcccacgagtgcggccaccacgccttcagcaactac

SEQ ID NO: 5753 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttgcctctctactgggcctgccaagggtgcgtcctaaccggcgtctgggtcatagcccacgagtgcggccaccacgccttcagcgactac

SEQ ID NO: 5754 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaaccggcgtctgggtcatagcccacgagtgcggccaccacgccttcagcgactac

SEQ ID NO: 5755 - DNA, 441 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctgaccctctctcctactggtggccatcgccagccacgatggtggcaagcaggcgctggagacggtccagcggctgttgccggtgctgtgccaggcccacggcttgacccctggcctctctactgggcctgccaagggtgcgtcctaaccggcgtctgggtcatagcccacgagtgcggccaccacgccttcagcgactac

SEQ ID NO: 5756 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaaggctgcgtcctaacgggcctctgggtcatcgcccacgaatgcggccaccacgccttcagcgactac

SEQ ID NO: 5757 - DNA, 334 bp, Artificial
  Mutation in BnaA.FAD2.a introduced by TALE nuclease pair BnFAD2_T01
caggatccatgggtgcaggtggaagaatgcaagtgtatcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccagggctgcgtcctaaccggcgtctgggtcatagcccacgagtgcggccaccacgccttcagcgactac

SEQ ID NO: 5758 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaaccagcgtctgggtcatagcccacgagtgcggccaccacgccttcagcgactac

SEQ ID NO: 5759 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccaggcctctctactgggcctgccagggctgcggcctaaccggcgtcggggtcatagcccacgagtgcggcgaccacgccttcagcgactac

SEQ ID NO: 5760 - DNA, 342 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctactctctactgggcctgccagggctgcgtcctaaccggcgtctgggtcatagcccacgagtgcggccaccacgccttcagcgactac

SEQ ID NO: 5761 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaacgggcgtctgggtcatagcccacgagtgcggccaccacgccttcagcgactac

SEQ ID NO: 5762 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaacgggcctctgggtcatagcccacgagtgcggccaccacgccttcagcgactac

SEQ ID NO: 5763 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcaccaaggcctctctactgggcctgccaaggcggcgtcctaacgggcctctgggtcatagcccacgagtgcggccaccacgccttcagcgactac

SEQ ID NO: 5764 - DNA, 334 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccaaggctgcgtcctaacgggcctctgggtcatcgcccacgaatgcggccaccacgccttcagcgactac

SEQ ID NO: 5765 - DNA, 349 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttgggcctctctactgggcctgccaagggtgcgtcctaaccggcgtctgggtcatagcccacgagtgcggccaccacgccttcagcgactac

SEQ ID NO: 5766 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcagccaccacgccttcagcgactac

SEQ ID NO: 5767 - DNA, 434 bp, Artificial
  Mutation in BnaA.FAD2.a introduced by TALE nuclease pair BnFAD2_T01
caggatccatgggtgcaggtggaagaatgcaagtgtctcctcactccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcggcggttgccggtgctgtgccaggcccacggcttgaccccccagcaggtggtggccatcgccagcaatggcggtggcaagcaggcgctggaggcctggcccctctactgggcctgccaaggctgcgtcctaacgggcctctgggtcatcgcccacgagtgcggccaccacgccttcagcgactac

SEQ ID NO: 5768 - DNA, 344 bp, Artificial
  Mutation in BnaA.FAD2.a introduced by TALE nuclease pair BnFAD2_T01
caggatccatgggtgcaggtggatgaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctccctcaccctctctcctatcctctctactgggcctgccagggctgcgtcctaaccggcgtctgggtcatagcccacgagtgcggccaccacgccttcagcgactac

SEQ ID NO: 5769 - DNA, 341 bp, Artificial
  Mutation in BnaA.FAD2.a introduced by TALE nuclease pair BnFAD2_T01
caggatccatgggtgcaggtggaagaatgcaagtgtatcctcactccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacttcgccaccacttacttccctctcctccctcaccctctctcccccctttactgggcctgccagggctgcgtcctaaccggcgtctgggtcatagcccacgagtgcggccaccacgccttcagcgactac

SEQ ID NO: 5770 - DNA, 350 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 5771 - DNA, 342 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtctgagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccaagggtgcgtcctaaccggcgtctgggtcatagcccacgagtgcggccaccacgccttcagcgactac

SEQ ID NO: 5772 - DNA, 358 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgggtctggcctctctactaggcctgccagggctgcgtcctaaccggcgtctgggtcatagcccacgaatgcggccaccacgccttcagcgactac

SEQ ID NO: 5773 - DNA, 345 bp, Artificial
  Mutation in BnaA.FAD2.a introduced by TALE nuclease pair BnFAD2_T01
caggatccatgggtgcaggcggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccagggctgcgtcctaaccggcgtctgggtcatagcccacgagtgcggccaccacgccttcagcgactac

SEQ ID NO: 5774 - DNA, 334 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctgccaagggggcgtcctaacgggcctctgggtcatcgcccacgaatgcggccaccacgccttcagcgactac

SEQ ID NO: 5775 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaaggctgcgtcctaacgggcctctgggtcatcgcccacgaatgcggccaccacgccttcagcgactac

SEQ ID NO: 5776 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatccgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 5777 - DNA, 334 bp, Artificial
  Mutation in BnaA.FAD2.a introduced by TALE nuclease pair BnFAD2_T01
caggatccatgggtgcaggtggaagaatgcaagcgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccagggctgcgtcctaaccggcgtctgggtcatagcccacgagtgcggccaccacgccttcagcgactac

SEQ ID NO: 5778 - DNA, 312 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatcccacgctccttctcctcttcgacatcatcatctcctcctcggctcctccctcaccctctctcctacttggcctctctactgggcctgccagggctgcgtcctaaccggcgtcggggtcatagcccacgagtgcggccaccacgccttcagcgactac

SEQ ID NO: 5779 - DNA, 347 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacttgcctctctactgggcctgccagggctgcgtcctaaccggcgtctgggtcatagcccacgagtgcggccaccacgcctgcagcgactac

SEQ ID NO: 5780 - DNA, 357 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcgcgcctggcctctctactgggcctgccaagggtgcgtcctaaccggcgtctgggtcatagcccacgagtgcggccaccacgccttcagcgactac

SEQ ID NO: 5781 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcccctctactgggcctgccaaggctgcgtcctaacgggcctctgggtcatcgcccacgaatgcggccaccacgccttcagcgactac

SEQ ID NO: 5782 - DNA, 403 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctcctccgcatccctgcccccctttcccccttcgggaagcgtggcgctttctcatagctcaggcctctctactgggcctgccaagggtgcgtcctaaccggcgtctgggtcatagcccacgagtgcggccaccacgccttcagcgactac

SEQ ID NO: 5783 - DNA, 355 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcctttggcctctctactgggcctgccaaggctgcgtcctaacgggcctctgggtcatcgcccacgaaggcggccaccacgccttcagcgactac

SEQ ID NO: 5784 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctccctcaccctctctcctacttggcctctctactgggcctgccagggctgcgtcctaaccggcgtctgggtcatagcccacgagtgcggccaccacgccttcagcgactac

SEQ ID NO: 5785 - DNA, 332 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccagggctgcgtcctaaccggcgtctgggtcatcgcccacgaatgcggccaccacgccttcagcgactac

SEQ ID NO: 5786 - DNA, 351 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttcgcggcctctctactgggcctgccagggctgcgtcctaaccggcgtctgggtcatagcccacgagtgcggccaccacgccttcagcgactac

SEQ ID NO: 5787 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgccctttctcctacctcatctgggacatcatcatagcctcctgcttctactacgtcgccaccacttacttccctctcctccctcaccctctcgcctggcctctctactgggcctgccaagggtgcgtcctaaccggcgtctgggtcatagcccacgagtgcggccaccacgccttcagcgactac

SEQ ID NO: 5788 - DNA, 344 bp, Artificial
  Mutation in BnaA.FAD2.a introduced by TALE nuclease pair BnFAD2_T01
caggatccatgggtgcagtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccagggctgcgtcctaaccggcgtctgggtcatagcccacgagtgcggccaccacgccttcagcgactac

SEQ ID NO: 5789 - DNA, 341 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgggcctgccagggctgcgtcctaaccggcgtctgggtcatagcccacgagggcggccaccacgccttcagcgactac

SEQ ID NO: 5790 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctccgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 5791 - DNA, 358 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcgcctcgtctggcccctctactgggcctgccaaggctgcgtcctaaccggcgtctgggtcatagcccacgagtgcggccaccacgccttcagcgactac

SEQ ID NO: 5792 - DNA, 332 bp, Artificial
  Mutation in BnaA.FAD2.a introduced by TALE nuclease pair BnFAD2_T01
caggatccatgggtgcaggtggaagaatgtaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccagggctgcgtcctaaccggcgtctgggtcatagcccacgagtgcggccaccacgccttcagcgactac

SEQ ID NO: 5793 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccaaggctgcgtcctaaccggcgtctgggtcatagcccacgagtgcggccaccacgccttcagcgactac

SEQ ID NO: 5794 - DNA, 344 bp, Artificial
  Mutation in BnaA.FAD2.a introduced by TALE nuclease pair BnFAD2_T01
caggatccatgggtgcaggtggcagaatgcaagtgtctcctccctccaataagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatcctctctactgggcctgccagggctgcgtcctaaccggcgtctgggtcatagcccacgagtgcggccaccacgccttcagcgactac

SEQ ID NO: 5795 - DNA, 354 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctggcctctctactgggcctgccaagggtgcgtcctaaccggcgtctgggtcatagcccacgagtgcggccaccacgccttcagcgactac

SEQ ID NO: 5796 - DNA, 334 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactcggcctgccagggctgcgtcctaacgggcctctgggtcatcgcccacgaatgcggccaccacgccttcagcgactac

SEQ ID NO: 5797 - DNA, 436 bp, Artificial
  Mutation in BnaA.FAD2.a introduced by TALE nuclease pair BnFAD2_T01
caggatccatgggtgcaggtggaagaatgcaagtgtctcctccctccaaaaaatctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctggctggcgatggccaccacctgctccggggtcaagccgtgggcctggcatctctgccaaatagttgggagccaatgagggcaggcctctctactgggcctgccaagggtgcgtcctaacgggcctctgggtcatagcccacgagtgcggccaccacgccttcagcgactac

SEQ ID NO: 5798 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcggcctctctactgggcctgccagggctgcgtcctaaccggcgtctgggtcatagcccacgagtgcggccaccacgccttcagcgactac

SEQ ID NO: 5799 - DNA, 329 bp, Artificial
  Mutation in BnaA.FAD2.a introduced by TALE nuclease pair BnFAD2_T01
caggatccatgggtgcaggtggaagaatgcaagtgtctcctcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctgggcctgccagggctgcgtcctaaccggcgtctgggtcatagcccacgagtgcggccacgacgccttcagcgactac

SEQ ID NO: 5800 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccagggctgcgtcctaaccggcgtctgggtcatagcccacgagtgcggccaccacgcctgcagcgactac

SEQ ID NO: 5801 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcagcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 5802 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccagggctgcgtcctaaccggcgtctgggtcatagcccacgagtgcggccaccacgccttcagcgactac

SEQ ID NO: 5803 - DNA, 346 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactaggcctgccagggctgcgtcctaaccggcgtctgggtcatagcccacgagtgcggccaccacgccttcagcgactac

SEQ ID NO: 5804 - DNA, 455 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgctggaccgtctccagcgcctgcttgccgccatcgtggctggcgatggccaccacctgctccggggtcaagccgtgggcctggcacagcaccggcaacagccgcttggcctctctactgggcctgccagggctgcgtcctaaccggcgtctgggtcatagcccacgagtgcggccaccacgccttcagcgactac

SEQ ID NO: 5805 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctccttctactacgtcgccaccgcttacttccctcgcctccctcaccctctctcctccaacctagcctctctactgggcctaccagggctgcgtcctaaccgacgactgggtcatcgcccacatgtgcggccaccgcgcctgcagcgactac

SEQ ID NO: 5806 - DNA, 356 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccagtgctgcgtcctaacctgcgtctgggtcatagcccacgagtgcggccaccacgccttcagcgactac

SEQ ID NO: 5807 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtcttaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccaagggtgcgtcctaaccggcgtctgggtcatagcccacgagtgcggccaccacgccttcagcgactac

SEQ ID NO: 5808 - DNA, 346 bp, Artificial
  Mutation in BnaA.FAD2.a introduced by TALE nuclease pair BnFAD2_T01
caggatccatgggtgcaggcggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgagtgcggccaccacgccttcagcgactac

SEQ ID NO: 5809 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacggcccctctaccggtcctgccagggctgcgtcctaacgggccgctgggtcatagcccacgagttcggccaccacgccttcagcgactac

SEQ ID NO: 5810 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccccacttggcctctctactgggcctgccagggctgcgtcctaaccggcgtctgggtcatagcccacgagtgcggccaccacgccttcagcgactac

SEQ ID NO: 5811 - DNA, 349 bp, Artificial
  Mutation in BnaA.FAD2.a introduced by TALE nuclease pair BnFAD2_T01
cagtatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaacgggcctctgggtcatcgcccacgaatgcggccaccacgccttcagcgactac

SEQ ID NO: 5812 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcattgcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 5813 - DNA, 344 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagaactcaagaaagcaatcccaccgcactgtttcaaacgctcgatccctcgctctttctcctacctcatctgggacatcatcatagcctcctgcttctactacgtcgccaccacttacttccctctactccctcaccctctctcctactctctctactgggcctgccagggctgcgtcctaaccggcgtctgggtcatagcccacgagtgcggccacaacgccttcagcgactac

SEQ ID NO: 5814 - DNA, 345 bp, Artificial
  Mutation in BnaA.FAD2.a introduced by TALE nuclease pair BnFAD2_T01
caggatccatgggtgcaggtggaagaatgcaagtctatcctccctccatctcccccgaaaccaaaaccctcaaacgcgtcccctgcgagacaccacccttcactgtcggagaactcaagaaagcaatcccaccgcactgtttcaaacgctcgatctctcgctctttctcctacctcatctgggacatcatcatagcctcctgcttctactacgtcgccaccacttacttccctctcctccctcaccctctctcctaggcctctctactgggcctgccagggctgcgtcctaaccggcgtctgggtcatagcccacgagtgcggccaccacgccttgagcgactac

SEQ ID NO: 5815 - DNA, 350 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctacggggcctgccagggctgcgtcctaaccggcgtctgggtcatagcccacgagtgcggccaccacgccttcagcgactac

SEQ ID NO: 5816 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctggcctctctactgggcctgccagggctgcgtcctaaccggcgtctgggtcatagcccactagtgcggccaccacgccttcagcgactac

SEQ ID NO: 5817 - DNA, 349 bp, Artificial
  Mutation in BnaA.FAD2.a introduced by TALE nuclease pair BnFAD2_T01
caggatccatgggtgcaggtggcagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctttggcctctctactgggcctgccagggctgcgtcctaaccggcgtctgggtcatagcccacgagtgcggccaccacgccttcagcgactac

SEQ ID NO: 5818 - DNA, 344 bp, Artificial
  Mutation in BnaA.FAD2.a introduced by TALE nuclease pair BnFAD2_T01
caggatccatgggtgcaggtggcagaatgcaagtgtctcctccctccaagaagtctgaaaccgacaccatcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccagggcggcgtgctaaccgtcgtctgggtcatagcccacgaggtcggccaccacgccttcagcgactac

SEQ ID NO: 5819 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcacggtttcaaacgctcgatccctcgctctttctcctacctcatctgggacatcatcatagcctcctgcttctactacgtcgccgccacttacttccctctcctccctcaccctctctccgacttggcctctctactgggcctgccagggctgcgtcctaaccggcgtctgggtcatagcccacgagtgcggccaccacgccttcagcgactac

SEQ ID NO: 5820 - DNA, 346 bp, Artificial
  Mutation in BnaA.FAD2.a introduced by TALE nuclease pair BnFAD2_T01
caggatccatgggtgcaggtggaagaatgcaagtgtatactccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctatcctccctcaccctctctcctacttcctctctactgggcctgccagggctgcgtcctaaccggcgtctgggtcatagcccacgagtgcggccaccacgccttcagcgactac

SEQ ID NO: 5821 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagtgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctctctactgggcctgccagggctgcgtcctaaccggcgtctgggtcatagcccacgagtgcggccaccacgccttcagcgactac

SEQ ID NO: 5822 - DNA, 337 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctctctactgggcctgccaagggtgcgtcctaaccggcgtctgggtcatagcccacgagtgcggccaccacgccttcagcgacta

SEQ ID NO: 5823 - DNA, 409 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacttcgctggagacggtgcaggcgctgttgcctgtgctgtgccaggcccacggcttgacccccctggcctctctactgggcctgccagggctgcgtcctaaccggcgtctgggtcatagcccacgagtgcggccaccacgccttcagcgactac

SEQ ID NO: 5824 - DNA, 347 bp, Artificial
  Mutation in BnaA.FAD2.a introduced by TALE nuclease pair BnFAD2_T01
caggatccatgggtgcaggtgcaagaatgcaagtgtctcctcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgactagcctctctacggggcctgccagggctgcgtcctaaccggcggctggggcatagcccacgagtgcggccaccacgcctgcagcgactac

SEQ ID NO: 5825 - DNA, 342 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccaagggtgcgtcctaacgggcctctgggtcatagcccacgagtgcggccaccacgccttcagcgactac

SEQ ID NO: 5826 - DNA, 341 bp, Artificial
  Mutation in BnaA.FAD2.a introduced by TALE nuclease pair BnFAD2_T01
caggatccatgggtgcaggtggaagaatgcaagtgtctcctccctccagctcccccggaaccaacaccctcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctactgggcctgccagggctgcgtcctaaccggcgtctgggtcatagcccacgagtgcggccaccacgccttcagcgactac

SEQ ID NO: 5827 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccagggctgcgtcctaaccggcgtctgggtcatagcccacgagtgcggccaccacgccttcagcgactag

SEQ ID NO: 5828 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcacact

SEQ ID NO: 5829 - DNA, 332 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcatagcccacgagtgcggccaccacgccatcagcgactac

SEQ ID NO: 5830 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctcgatccctcgctctttctcctacctcatccgggacatcatcatagcctcctgcttctactacgtcgccaccacttacttccctctcctccctcaccctctctcctacttcctctctactgggcctgccagggctgcgtcctaaccggcgtctgggtcatagcccacgagtgcggccaccacgccttcagcgactac

SEQ ID NO: 5831 - DNA, 349 bp, Artificial
  Mutation in BnaA.FAD2.a introduced by TALE nuclease pair BnFAD2_T01
caggatccatgggtgcaggtggaagaatgcaagtgtcccctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctttcctggcctctctactgggcctgccaaggctgcgtcctaacgggcctctgggtcatagcccacgagtgcggccaccacgccttcagcgactac

SEQ ID NO: 5832 - DNA, 417 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtcaggacatgatcgcagcgttgccagagcgagattctccgcgctgtagaagtcaccattgttgtgctggcctctctactgggcctgccagggctgcgtcctaacgggcctctgggtcatcgcccacgaatgcggccaccacgccttcagcgactac

SEQ ID NO: 5833 - DNA, 434 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctcggctgttgccggtgctgtgccaggcccacggcttgaccccccagcaggtggtggccatcgccagcaatggcggtggcaagcaggcgctggaggcctggcctctctactgggcctgccagggctgcgtcctaaccggcgtctgggtcatagcccacgagtgcggccaccacgccttcagcgactac

SEQ ID NO: 5834 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccagggctgcgtcctaaccggcgtctgggtcgtagcccacgagtgcggccaccacgccttcagcgactac

SEQ ID NO: 5835 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctggcctctctactgggcctgccagggctgtgtcctaaccggcgtctgggtcatagcccacgagtgcggccaccacgccttcagcgactac

SEQ ID NO: 5836 - DNA, 300 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagccacctgcttctactacgtctctctactgggcctgccaagggtgcgtcctaaccggcgtctgggtcatagcccacgagtgcggccaccacgccttcagcgactac

SEQ ID NO: 5837 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaacagacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcgctggcctctctactgggcctgccagggctgcgtcctaacgggcctctgggtcatcgcccacgaatgcggccaccacgccttcagcgactac

SEQ ID NO: 5838 - DNA, 338 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgtttcaaacgctcgatccctcgctctttctcctacctcatctgggacatcatcatagcctcctgcttctactacgtcgccaccacttacttccctctcctccctcaccctctctcctattactgggcctgccagggctgcgtcctaaccggcgtctgggtcatagcccacgagtgcggccaccacgccttcagcgactac

SEQ ID NO: 5839 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgccctggcctctctactgggcctgccagggctgcgtcctaaccggcgtctgggtcatagcccacgagtgcggccaccacgccttcagcgactac

SEQ ID NO: 5840 - DNA, 343 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccagggctgcgtcctaaccggcgtctggttcatagcccacgagtgcggccaccacgccttcagcgactac

SEQ ID NO: 5841 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacctcaagcgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccaagggtgcgtcctaaccggcgtctgggtcatagcccacgagtgcggccaccacgccttcagcgactac

SEQ ID NO: 5842 - DNA, 336 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctgggcctgccaaggctgcgtcctaacgggcctctgggtcatagcccacgagtgcggccaccacgccttcagcgactac

SEQ ID NO: 5843 - DNA, 342 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttctctctcctccctcaccctctctcctactctctactgggcctgccagggctgcgtcctaaccggcgtctgggtcatagcccacgagtgcggccaccacgccttcagcgactac

SEQ ID NO: 5844 - DNA, 332 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgggcctgccagggctgcgtcctaaccggcgtctaggtcatagcccacgagtgcggccaccacgccttcagcgactac

SEQ ID NO: 5845 - DNA, 348 bp, Artificial
  Mutation in BnaA.FAD2.a introduced by TALE nuclease pair BnFAD2_T01
caggatccatgggtgcaggtgggagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 5846 - DNA, 340 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgacggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgctttactgggcctgccggggctgcgtcctaaccggcgtctgggtcatagcccaccagtgcggccaccacgccctcagcgactac

SEQ ID NO: 5847 - DNA, 452 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactaacagaaattatatgataatcatcgcaagaccggcaacaggattcaatcttaagaaactttattgccaaatgtttgaaacgaccttttggaaacttcggcttcctggcctctctactgggcctgccaagggtgcgtcctaaccggcgtctgggtcatagcccacgagtgcggccaccacgccttcagcgactac

SEQ ID NO: 5848 - DNA, 436 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccctggctggcgatggccaccacctgctccggggtcaagccgtgggcctggcatctctgccaaatagttgggagccaatgagggcaggcctctctactgggcctgccaagggtgcgtcctaaccggcgtctgggtcatagcccacgagtgcgaccaccacgccttcagcgactac

SEQ ID NO: 5849 - DNA, 358 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgggtctggcctctctactaggcctgccagggctgcgtcctaacgggcctctgggtcatagcccacgagtgcggccaccacgccttcagcgactac

SEQ ID NO: 5850 - DNA, 339 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttactgggcctgccagggctgcgtcctaacgggcctctgggtcatagcccacgagtgcggccaccacgccttcagcgactac

SEQ ID NO: 5851 - DNA, 343 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatagcccacgagtgcggccaccacgccttcagcgactac

SEQ ID NO: 5852 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccagggctgcgtcctaaccggcgtctgggtcatagcccacgagtgcggccaccacgccatcagcgactac

SEQ ID NO: 5853 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcacccactctcctacttggcctctctactgggcctgccagggctgcgtcctaaccggcgtctgggtcatagcccacgagtgcggccaccacgccttcagcgactac

SEQ ID NO: 5854 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcccgcctggcctctctactgggcctgccagggctgcgtcctaaccggcgtctgggtcatagcccacgagtgcggccaccacgccttcagcgactac

SEQ ID NO: 5855 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtcccctgcgagacaccaccattcactctcggagacctcaagaaagcaatcccacctcactgcttcaaacgctccatcccacgctccttctcctcttcgacatcatcatctcctcctcggctcctccctctaccacctctccacagcctacttccctctcctccctcaccctctctcctacttggcctctctactgggcctgccaagggtgcgtcctaaccggcgtctgggtcatagcccacgagtgcggccaccacgccttcagcgactac

SEQ ID NO: 5856 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccccccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctaggcctctctactgggcctgccagggctgcgtcctaaccggcgtctgggtcatagcccacgagtgcggccaccacgccttcagcgactac

SEQ ID NO: 5857 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcccctctactgggcctgccaaggctgcgtcctaaccggcgtctgggtcatagcccacgagtgcggccaccacgccttcagcgactac

SEQ ID NO: 5858 - DNA, 429 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtgcgtcctgcccgccaccctccgggccgttgcttcacaccatcgtggctggcgatggccaccacctgctccggggtcatggcctctctactgggcctgccagggctgcgtcctaaccggcgtctgggtcatagcccacgagtgcggccaccacgccttcagcgactac

SEQ ID NO: 5859 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgcccgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 5860 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaacgggcctctgggtcatagcccacgagtgcggccaccacgccttcagcgactac

SEQ ID NO: 5861 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcaggcctctctactgggcctgccagggctgcgtcctaaccggcgtctgggtcatagcccacgagtgcggccaccacgccttcagcgactac

SEQ ID NO: 5862 - DNA, 350 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtccccaccacttacttccctctcctccctcaccctctctcctacttctggcctctctactgggcctgccagggctgcgtcctaacccgcgtctgggtcatagcccgcgagtgcggccaccacgccttcagcgactac

SEQ ID NO: 5863 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggggcctgccagggctgcgtcctaaccggcgtctgggtcatagcccacgagtgcggccaccacgccttcagcgactac

SEQ ID NO: 5864 - DNA, 351 bp, Artificial
  Mutation in BnaA.FAD2.a introduced by TALE nuclease pair BnFAD2_T01
caggatccatgggtgcaggttgaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctcgtggcctctctactgggcctgccagggctgcgtcctaaccggcgtctgggtcatagcccacgagtgcggccaccacgccttcagcgactac

SEQ ID NO: 5865 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttccggcctctctactgggcctgccagggctgcgtcctaaccggcgtctgggtcatagcccacgagtgcggccaccacgccttcagcgactac

SEQ ID NO: 5866 - DNA, 378 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctccagcgcctgcttgccgccatcgtggctggcgatggccaccaccggctccggggtcaagccgtgagggctgggtcatagcccacgagtgcggccaccacgccttcagcgactac

SEQ ID NO: 5867 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgggcctctctactgggcctgccaagggtgcgtcctaaccggcgtctgggtcatagcccacgagtgcggccaccacgccttcagcgacta

SEQ ID NO: 5868 - DNA, 357 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctaacctggcctctctactgggcctgccagggctgcgtcctaaccggcgtctgggtcatagcccacgagtgcggccaccacgcctcagcgactac

SEQ ID NO: 5869 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccacctcttacttccctctcctccctcaccctcctctctactgggcctgccagggctgcgtcctaaccggcgtctgggtcatagcccacgagtgctgccaccacgccttcagcgactac

SEQ ID NO: 5870 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgtgacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 5871 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccatctcctccctcaccctctctcctactgggcctctctactgggcctgccagggctgcgtcctaaccggcgtcggggtcatagcccacgagtgcggccaccacgccttcagcgactac

SEQ ID NO: 5872 - DNA, 354 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggtggcctctctactgggcctgccagggctgcgtcctaaccggcgtctgggtcatagcccacgagtgcggccaccacgccttcagcgactac

SEQ ID NO: 5873 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgctaccacttacttccctctcctccctcaccctctctcctaggcctctctactgggcctgccaagggtgcgtcctaaccggcgtctgggtcatagcccacgagtgcggccaccacgccttcagcgactac

SEQ ID NO: 5874 - DNA, 357 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccaacaacatcaagcgcgtaccctgcgagacaccgcccttcactgtcggagaactcaagaaagcaatcccaccgcactgtttcaaacgctcgatccctcgctctttctcccacctcatctgggacatcatcatagcctcctgcttctactacgtccccaccacttacttccctctcctccctcaccggtttgcgtattgccggtgcctggcctctctactgggcctgccaagggtgcgtcctaaccggcgtctgggtcatagcccacgagtgcggccaccacgccttcagcgactac

SEQ ID NO: 5875 - DNA, 351 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccagggctgcgtcctaacgggcctctgggtcatagcccacgagtgcggccaccacgccttcagcgactac

SEQ ID NO: 5876 - DNA, 351 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggcctctctactgggcctgccagggctgcgtcctaaccggcgtctgggtcatagcccacgagtgcggccaccacgccttcagcgactac

SEQ ID NO: 5877 - DNA, 332 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcagcctctccactgggccttcccagggttcctcctaaccggcgtcttgggcatagcccacgagttcggccaccccgccctcagcgactac

SEQ ID NO: 5878 - DNA, 347 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctacttgcctctctactgggcctgccagggctgcgtcctaaccggcgtctgggtcatagcccacgagtgcggccaccacgccttcagcgactac

SEQ ID NO: 5879 - DNA, 347 bp, Artificial
  Mutation in BnaA.FAD2.a introduced by TALE nuclease pair BnFAD2_T01
caggatccatgggtgcaggtggaagaatgcaagtgactcctccctccaaaaagtctgaaaccgacaacatcaagcgcgtaccctgcgagacaccgcccttcactgtcggagaactcaagaaagcaatcccaccccactgtttcaaacgctcgatccctcgctctttctcctacctcatctgggacatcatcatagcctcctgcttctactacgtcgccaccacttacttccctctcctccctcaccctctctcctcctcgcctctctacggggcctgccagggctgcgtcctaaccggcgtcggggtcatatcccacgagtgcggccaccacgccttcagcgactac

SEQ ID NO: 5880 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccaagggtgcgtcctaaccggcgtctggatcatcgcccacgaatgcggccaccacgccttcagcgactac

SEQ ID NO: 5881 - DNA, 349 bp, Artificial
  Mutation in BnaA.FAD2.a introduced by TALE nuclease pair BnFAD2_T01
caggatccatgggtgcaggtggaagaatgcaagtgtatcctccctccaaaaagtctgaaaccgacaacatcaagcgagtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttagttccctctcctccctcaccctctctcctgccctggcctctctactgggcctgccaaggctgcttcctaacgggcctcggggtcatcgcccacgaatgcggccaccacgccttcagcgactac

SEQ ID NO: 5882 - DNA, 339 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctacttactgggcctgccagggctgcgtcctaaccggcgtctgggtcatagcccacgagtgcggccaccacgccttcagcgactac

SEQ ID NO: 5883 - DNA, 329 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctgggcctgccagggctgcgtcctaacgggcctctgggtcatcgcccacgaatgcggccaccacgccttcagcgactac

SEQ ID NO: 5884 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccacactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaacgggcctctgggtcatagcccacgagtgcggccaccacgccttcagcgactac

SEQ ID NO: 5885 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctggcctctctactgggcctgccagggctgcgtcctaaccggcgtctgggtcatagcccacgagtgcggccaccacgccttcagcgactac

SEQ ID NO: 5886 - DNA, 323 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctcgagccacccactgggcctgccaagggtgcgtcctaacgggcctctgggtcatcgcccacgaatgcggccaccacgccttcagcgactac

SEQ ID NO: 5887 - DNA, 357 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccccccgcctggcctctctactgggcctgccagggctgcgtcctaaccggcgtttgggtcatagcccacgagtgcggccaccacgccttcagcgactac

SEQ ID NO: 5888 - DNA, 348 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttgcctctctactgggcctgccaagggtgcgtcctaacgggcctctgggtcatagcccacgagtgcggccaccacgccttcagcgactac

SEQ ID NO: 5889 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaagggtgcgtcctaacgggcgtctgggtcatagcccacgagtgcggccaccacgccttcagcgactac

SEQ ID NO: 5890 - DNA, 343 bp, Artificial
  Mutation in BnaA.FAD2.a introduced by TALE nuclease pair BnFAD2_T01
caggatccatgggtgcaggtggaagaatgcaagtgtctcctccttccaaaaagtctgaaaccgacaacatcaagcgcgtaccctgcgagacaccgcccttcactgtcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccagggctgcgtcctaaccggcgtctgggtcatagcccacgagtgcggccaccacgccgttagcgactac

SEQ ID NO: 5891 - DNA, 338 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactactgggcctgccagggctgcgtcctaaccggcgtctgggtcatagcccacgagtgcggccaccacgccttcagcgactac

SEQ ID NO: 5892 - DNA, 332 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctccatccctcgctctttctcctacctcatctgggacatcatcatagcctcctgcttctactacgtcgccaccacttacttccctctcctccctcaccctctctactgggcctgccaagggtgcgtcctaacgggcctctgggtcatagcccacgagtgcggccaccacgccttcagcgactac

SEQ ID NO: 5893 - DNA, 350 bp, Artificial
  Mutation in BnaA.FAD2.a introduced by TALE nuclease pair BnFAD2_T01
caggatccatgggtgcaggtcgaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtctggcctctctactgggcctgacagggctgcgtcctaaccggcctctgggtcatagcccacgagtgcggccaccacgccttcagcgactac

SEQ ID NO: 5894 - DNA, 346 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccagggctgcgtcctaaccggcgtctgggtcatagaccacgagtgcggccaccacgccttcagcgactac

SEQ ID NO: 5895 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctccaacctcatctgggacatcatcatagcctcctgcttctactacgtcgccaccacttacttccctcgcctccctccccctctctcctactcgcctctctactgggcctgccagggctgcgtcctaaccggcgtctgggtcatagcccacgagtgcggccaccacgccttcagcgactac

SEQ ID NO: 5896 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaaggatgcgtcctaaccggcgtctgggtcatagcccacgagtgcggccaccacgccttcagcgactac

SEQ ID NO: 5897 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctcgatccctcgctctttctcctacctcatctgggacatcatcatagcctcctgcttctactacgtcgccaccacttacttccctctcctccctcaccctctctcctacggcctctctactgggcctgccaagggtgcgtcctaaccggcctctgggtcatagcccacgagtgcggccaccacgccttcagcgactac

SEQ ID NO: 5898 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtacccttcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcgctggcctctctactgggcctgccagggctgcgtcctaaccggcgtctgggtcatagcccacgagtgcggccaccacgccttcagcgactac

SEQ ID NO: 5899 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtcttggtcatagcccacgagtgcggccaccacgccttcagcgactac

SEQ ID NO: 5900 - DNA, 358 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctaacctggcctctctactgggcctgccagggctgcgtcctaaccggcgtctgggtcatagcccacgagtgcggccaccacgccttcagcgactac

SEQ ID NO: 5901 - DNA, 355 bp, Artificial
  Mutation in BnaA.FAD2.a introduced by TALE nuclease pair BnFAD2_T01
caggatccatgggtgcaggtggaagaatgtaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcgcctggcctctctactgggcctgccagggctgcgtcctaaccggcgtctgggtcatagcccacgagtgcggccaccacgccttcagcgactac

SEQ ID NO: 5902 - DNA, 334 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcgctgccaagggtgcgtcctaaccggcgtcggggtcatagcccacgagtgcggccaccacgccttcagcgactac

SEQ ID NO: 5903 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggcctctctactgggcctgccagggctgcgtcctaaccggcctctgggtcatcgcccacgaatgcggccaccacgccttcagcgactac

SEQ ID NO: 5904 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaaaatcaagcgcgtaccctgcgagacaccgcccttcactgtcggagaactcaagaaagcaatcccaccgcactgtttcaaacgctcgatccctcgctcgttctcctacctcatctgggacatcatcatagcctcctgcttctactacgtcgacaccacttacttctctctcctccctcaccctctctccctgacctctctactgggccggccagggctgcgtcctaaccggcgtctgggtcatagcccacaagtgcggccaccacgccttcagcgactac

SEQ ID NO: 5905 - DNA, 340 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctactttactgggcctgccagggctgcgtcctaaccggcgtctgggtcatagcccacgagtgcggccaccacgccttcagcgactac

SEQ ID NO: 5906 - DNA, 350 bp, Artificial
  Mutation in BnaA.FAD2.a introduced by TALE nuclease pair BnFAD2_T01
caggatccatgggtgcaggtggaagaatgcaagtgtctcatccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 5907 - DNA, 341 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgggcctgccagggctgcgtcctaacgggcctctgggtcatcgcccacgaatgcggccaccacgccttcagcgactac

SEQ ID NO: 5908 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctggcacatcatcatagcctcctgcttctactacgtcgccaccacttacttccctctcctccctcaccctctctcctccttgcctctctactgggcctgccagggctgcgtcctaaccggcgtctgggtcatagcccacgagtgcggccaccacgccttcagcgactac

SEQ ID NO: 5909 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctactgggcctgccaagggtgcgtcctaaccggcgtctgggtcatagcccacgagtgcggccaccacgccttcagcgactac

SEQ ID NO: 5910 - DNA, 344 bp, Artificial
  Mutation in BnaA.FAD2.a introduced by TALE nuclease pair BnFAD2_T01
caggatccatgggtgcaggtggaagaatgcaagtgtctcctccctcccagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccagggctgcgtcctaaccggcgtctgggtcatagcccacgagtgcggccaccacgccttcagcgactac

SEQ ID NO: 5911 - DNA, 429 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgggcgtccggcccgccaccctccgggccgttgcttcacaccatcgtggctggcgatggccaccacctgctccggggtcatggcctctctactgggcctgccagggctgcgtcctaaccggcgtctgggtcatagcccacgagtgcggccaccacgccttcagcgactac

SEQ ID NO: 5912 - DNA, 334 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcacccactctctactgggcctgccagggctgcgtcctaaccggcgtctgggtcatagcccacgagtgcggccaccacgccttcagcgactac

SEQ ID NO: 5913 - DNA, 341 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccacaacttacttccctctcctccctcacactctctcctacttctactgggcctgccagggctgcgtcctaaccggcgtctgggtcatagcccacgagtgcggccaccacgccttcagcgactac

SEQ ID NO: 5914 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccccttacttccctctcctccctcaccctctctcctagcctctctactgggcctgccagggctgcgtcctaaccggcgtctgggtcatagcccacgagtgcggccaccacgccttcagcgactac

SEQ ID NO: 5915 - DNA, 322 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctcgagccacccactgggcctgccaaggctgcgtcctaacgggcctctgggtcatagcccacgagtgcggccaccacgcttcagcgactac

SEQ ID NO: 5916 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgctggcctctctactgggcctgccaagggtgcgtcctaacgggcctctgggtcatcgcccacgaatgcggccaccacgccttcagcgactac

SEQ ID NO: 5917 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctccactgggcctgccaagggtgcgtcctaaccggcgtctgggtcatagcccacgagtgcggccaccacgccttcagcgactac

SEQ ID NO: 5918 - DNA, 378 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctccagcgcctgcttgccgccatcgtggctggcgatggccaccacctgctccggggtcaagccgtgagggctgggtcatagcccacgagtgcggccaccacgccttcagcgactac

SEQ ID NO: 5919 - DNA, 342 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcttcatagcctcctgcttctactacgtcgccaccacttacttccctctcctccctcaccctcgcctggcctctctactgggcctgccaagggtgcgtcctaacgggcctctgggtcatcgcccacgaatgcggccaccacgccttcagcgactac

SEQ ID NO: 5920 - DNA, 321 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcaaggctgcgtcctaacgggcctctgggtcatcgcccacgaatgcggccaccacgccttcagcgactac

SEQ ID NO: 5921 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtaatagcccacgagtgcggccaccacgccttcagcgactac

SEQ ID NO: 5922 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggccatagcccacgagtgcggccaccacgccttcagcgactac

SEQ ID NO: 5923 - DNA, 345 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccagggctgcgtcctaacgggcctctgggtcatcgcccacgaatgcggccaccacgccttcagcgactac

SEQ ID NO: 5924 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgcccctggcctctctactgggcctgccaagggtgcgtcctaacgggcgtctgggtcatagcccacgagtgcggccaccacgccttcagcgactac

SEQ ID NO: 5925 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacctcggcgcctctactgggcctgccaaggctgcgtcctaacgggcctctgggtcatcgcccacgaatgcggccaccacgccttcagcgactac

SEQ ID NO: 5926 - DNA, 325 bp, Artificial
  Mutation in BnaA.FAD2.a introduced by TALE nuclease pair BnFAD2_T01
caggatccatgggtgcaggtggaagaatgcaagtatctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggctgcgtcctaaccggcgtctgggtcatagcccacgagtgcggccaccacgccttcagcgactac

SEQ ID NO: 5927 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctttcctccctcaccctctctcctacttggcctctctactgggcctgccaagggtgcgtcctaaccggcgtctgggtcatagcccacgagtgcggccaccacgccttcagcgactac

SEQ ID NO: 5928 - DNA, 346 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagaactcaagaaagcaatcccaccgcactgtttcaaacgctcgacccctcgctctttctcctacctcatctgggacatcatcatagcctcctgcttctactacgtcgccaccacttacttccctctcctccctcaccctctctcctacggcctctctactgggcctgccagggctgcgtcctaaccggcgtctgggtcatagcccacgagtgcggccaccacgccttcagcgactac

SEQ ID NO: 5929 - DNA, 415 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggagacgatggccaccacctgctggggggtcaagttgagcggggcacccgtcagtgcatgcatggcctctctactgggcctgccagggctgcgtcctaaccggcgtctgggtcatagcccacgagtgcggccaccacgccttcagcgactac

SEQ ID NO: 5930 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccccacttcgcctctctactgggcctgccagggctgcgtcctaacgggcctctgggtcatagcccacgagtgcggccaccacgccttcagcgactac

SEQ ID NO: 5931 - DNA, 409 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggagacggtgcaggcgctgttgccggtgctgtgccaggcccacggcttgacccccctggcctctctactgggcctgccagggctgcgtcctaaccggcgtctgggtcatagcccacgagtgcggccaccacgccttcagcgactac

SEQ ID NO: 5932 - DNA, 334 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctaccacatctgggacatcatcatagcctcctgcttctactacgtcgccaccacttacttccctctcctccctcaccctctctctactgggcctgccagggctgcgtcctaaccggcgtctgggtcatagcccacgagtgcggccaccacgccttcagcgactac

SEQ ID NO: 5933 - DNA, 347 bp, Artificial
  Mutation in BnaA.FAD2.a introduced by TALE nuclease pair BnFAD2_T01
caggatccatgggtgcaggtggaagaatgcaagtgtatcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcgcctctctactgggcctgccagggctgcgtccttaccggcgtctgggtcatagcccacgagtgcggccaccacgccttcagcgactac

SEQ ID NO: 5934 - DNA, 379 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaactgagcctttcgttttatctgttgtttgtcggtggcctctctactgggcctgccaagggtgcgtcctaaccggcgtctgggtcatagcccacgagtgcggccaccacgccttcagcgactac

SEQ ID NO: 5935 - DNA, 342 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcgcctggcctctctactgggcctgccaagggtgcgtcctaaccggcgtctgggtcatagcccacgagtgcggccaccacgccttcagcgactac

SEQ ID NO: 5936 - DNA, 324 bp, Artificial
  Mutation in BnaA.FAD2.a introduced by TALE nuclease pair BnFAD2_T01
caggatccatgggtgcaggtggaagaatgcaagtgtctcctccctccaaagagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcgccaagggtgcgtcctaaccggcgtctgggtcatagcccacgagtgcggccaccacgccttcagcgactac

SEQ ID NO: 5937 - DNA, 345 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccagggctgcgtcctaaccggcgtctgggtcatagcccacgagtgcggccaccacgccttcagcgactac

SEQ ID NO: 5938 - DNA, 343 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcccacttctctactgggcctgccagggctgcgtcctaaccggcgtctgggtcatagcccacgagtgcggccaccacgccttcagcgactcc

SEQ ID NO: 5939 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctggcctctctactgggcctgccagggctgcgtcctaaccggcgtctgggtcatagcccacgagtgcggccaccacgccttcagcgactac

SEQ ID NO: 5940 - DNA, 351 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccagggctgcgtcctaaccggcgtctgggtcatagcccacgagtgcggccaccacgccttcagcgactac

SEQ ID NO: 5941 - DNA, 380 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacagtggtccggcgcacgcgctctggaggcctgcctctctactgggcctgccagggctgcgtcctaaccggcgtctgggtcatagcccacgagtgcggccaccacgccttcagcgactac

SEQ ID NO: 5942 - DNA, 348 bp, Artificial
  Mutation in BnaA.FAD2.a introduced by TALE nuclease pair BnFAD2_T01
caggatccatgggtgcaggtggaagaatgcaagtgcctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 5943 - DNA, 405 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcaatgcactgacgggtgccccgctcaacttgaccccccagcaggtggtggccatcggcctctctactgggcctgccagggctgcgtcctaaccggcgtctgggtcatagcccacgagtgcggccaccacgccttcagcgactac

SEQ ID NO: 5944 - DNA, 321 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcaagggtgcgtcctaacgggcctctgggtcatagcccacgagtgcggccaccacgccttcagcgactac

SEQ ID NO: 5945 - DNA, 340 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctactctactgggcctgccagggctgcgtcctaaccggcgtctgggtcatagcccacgagtgcggccaccacgccttcagcgactac

SEQ ID NO: 5946 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagctcgtaccctgcgagacaccgcccttcactgtcggagaactcaagaaagcaatcccaccgcactgtttcaaacgctctatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 5947 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgcccccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 5948 - DNA, 349 bp, Artificial
  Mutation in BnaA.FAD2.a introduced by TALE nuclease pair BnFAD2_T01
caggatccagggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttttggcctctctactgggcctgccagggctgcgtcctaaccggcgtctgtgtcatagcccacgagtgcggccaccacgccttcagcgactac

SEQ ID NO: 5949 - DNA, 386 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccccgtgggcctggcaacgcaccggcaacagccgccggaccgtccccagcgcctgcctggcctctcttctgggcctgccaagggtgcgtcctaaccggcgtctgggtcatagcccacgagtgcggcccccacgccctcagcgaccacc

SEQ ID NO: 5950 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccaagggtgcgtcctaaccggcgtctgggtcatagcccacgagtgcggccaccacgccttcagcgactac

SEQ ID NO: 5951 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgcctgcagcgactac

SEQ ID NO: 5952 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcactcaccctctctcctaggcctctctactgggcctgccaagggtgcgtcctaaccggcgtctgggtcatagcccacgagtgcggccaccacgccttcagcgactac

SEQ ID NO: 5953 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccacactgtttcaaacgctcgatccctcgctctttctcctacctcatctgggacatcatcatagcctcctgcttctactacgtcgccaccacttacttccctctcctccctcaccctctctcctactggcctctctactgggcctgccagggctgcgtcctaaccggcgtctgggtcatagcccacgagtgcggccaccacgccttcagcgactac

SEQ ID NO: 5954 - DNA, 342 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccgccgcactgtttcaaacgctcgatccctcgctctttctcctacctcatctgggacatcatcatagcctcctgcttctactacgtcgccaccacttacttccctctcctccctcaccctctctcctcctctctactgggcctgccagggctgcgtcctaaccggcgtctgggtcatagcccacgagtgcggccaccacgccttcagcgactac

SEQ ID NO: 5955 - DNA, 343 bp, Artificial
  Mutation in BnaA.FAD2.a introduced by TALE nuclease pair BnFAD2_T01
catgatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctgcctctctactgggcctgccagggctgcgtcctaaccggcgtctgggtcatagcccacgagtgcggccaccacgccttcagcgactac

SEQ ID NO: 5956 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccaagggtgcgtcctaaccggcgtctgggtcatagcccatgagtgcggccaccacgccttcagcgactac

SEQ ID NO: 5957 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcctctctactgggcctgccaagggtgcgtcctaaccggcgtctgggtcatagcccacgagtgcggccaccacgccttcagcgactac

SEQ ID NO: 5958 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgccctgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 5959 - DNA, 340 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttactgggcctgccagggctgcgtcctaaccggcgtctgggtcatagcccacgagtgcggccaccacgccttcagcgactac

SEQ ID NO: 5960 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcaccgtcggagaactcaagaaagcaatcccaccgcactgtttcaaacgctccattcctcgctccttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 5961 - DNA, 334 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccagggctgcgtcctaacgggcctctgggtcatagccccgagtgcggccaccacgccttcagcgactac

SEQ ID NO: 5962 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcctctcccaccagtgcggccaccacgccttcagcgactac

SEQ ID NO: 5963 - DNA, 389 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtctccaccacttacttccctctcctccctcaccacccacgtatcaaccgtcgatcccctgctgaatattgaactgaaccagtcgactggcctctctactgggcctgccaagggtgcgtcctaacgggcctctgggtcatagcccacgagtgcggccaccacgccttcagcgactac

SEQ ID NO: 5964 - DNA, 338 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctacgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattactgggcctgccagggctgcgtcctaaccggcgtctgggtcatagcccacgagtgcggccaccacgccttcagcgactac

SEQ ID NO: 5965 - DNA, 339 bp, Artificial
  Mutation in BnaA.FAD2.a introduced by TALE nuclease pair BnFAD2_T01
caggatccattggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctggcctctctactgggcctgccaagggtgcgtcctaaccggcgtctgggtcatagcccacgagtgcggccaccacgccttcagcgactac

SEQ ID NO: 5966 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctccctggcctctctactgggcctgccaagggtgcgtcctaacgggcctctgggtcatagcccacgagtgcggccaccacgccttcagcgactac

SEQ ID NO: 5967 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcccctggcctctctactgggcctgccaagggtgcgtcctaaccggcgtctgggtcatagcccacgagtgcggccaccacgccttcagcgactac

SEQ ID NO: 5968 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccctctctactgggcctgccaaggctgcgtcctaacgggcctctgggtcatcgcccacgagtgcggccaccacgccttcagcgactac

SEQ ID NO: 5969 - DNA, 338 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgctctcaactgggcctgccaagggtgcgtcctaaccggcgtctgggtcatagcccacgagtgcggccaccacgccttcagcgactac

SEQ ID NO: 5970 - DNA, 380 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacttcacaggggtccggcgcacgcgcgcgggaggccggcctctctactgggcctgccaagggtgcgtcctaaccggcgtctgggtcatagcccacgagtgcggccaccacgccttcagcgactac

SEQ ID NO: 5971 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgccatcagcgactac

SEQ ID NO: 5972 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctaccaagggtgcgtcctaaccggcgtctgggtcatagcccacgagtgcggccaccacgccttcagcgacta

SEQ ID NO: 5973 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctccttctcctacctcatctgggacatcatcatagcctcctgcttctactacgtcgccaccacttacttccctctcctccctcaccctctctcctacttggcctctctactgggcctgccagggctgcgtcctaacgggcctctgggtcatagcccacgagtgcggccaccacgccttcagcgactac

SEQ ID NO: 5974 - DNA, 349 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaacgggcctctgggtcatagcccacgagtgcggccaccacgccttcagcgactac

SEQ ID NO: 5975 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccaagggtgcgtcctaacgggcctctgggtcatagcccacgagtgcggccaccacgccttcagcgactac

SEQ ID NO: 5976 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgcctctctactgggcctgccagggctgcgtcctaaccggcgtctgggtcatagcccacgagtgcggccaccacgccatcagcgactac

SEQ ID NO: 5977 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgcctggcctctctactgggcctgccaggggtgcgtcctaaccggcgtctgggtcatagcccacgagtgcggccaccacgccttcagcgactaa

SEQ ID NO: 5978 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcctcttcgacatcctcgtctcctcctccctctaccacctctccacagcctacttccctctcctcccccaccctctcccttaccttggcccctctactgggcctgccaagggtgcgtcctaaccggcgtctgggtcatagcccacgagtgcggccaccacgccttcagcgactac

SEQ ID NO: 5979 - DNA, 334 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctgccaagggtgcgtcctaacgggcctctgggtcatcgcccacgaatgcggccaccacgccatcagcgactac

SEQ ID NO: 5980 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccacctcactgcttcaaacgctccatccctcgctccttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 5981 - DNA, 354 bp, Artificial
  Mutation in BnaA.FAD2.a introduced by TALE nuclease pair BnFAD2_T01
caggtccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccagggctgcgtcctaaccggcgtctgggtcatagcccacgagtgcggccaccacgccttcagcgactac

SEQ ID NO: 5982 - DNA, 339 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctatcctctctactgggcctgccagggctgcgtcctaaccggcgtctgggtcatagcccacgagtgcggccaccacgccctcagcgactac

SEQ ID NO: 5983 - DNA, 438 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctaggcccagcgcctgcttgccgccaccgtggcgggcgatggccaccacctgctccggggtcaagccgtgggcctggcacagcaccggcaagcaggcgctgtctctactgggcctgccagggctgcgtcctaacgggcctctgggtcatcgcccacgaatgcggccaccacgcttcagcgactac

SEQ ID NO: 5984 - DNA, 347 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctactggcctctctactgggcctgccagggctgcgtcctaaccggcgtctgggtcatagcccacgagtgcggccaccacgccttcagcgactac

SEQ ID NO: 5985 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 5986 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccatcagcgactac

SEQ ID NO: 5987 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccagggctgcgtcctaaccggcgtctgggtcatagcccacgagtgcggccaccacgccttcagcgactac

SEQ ID NO: 5988 - DNA, 350 bp, Artificial
  Mutation in BnaA.FAD2.a introduced by TALE nuclease pair BnFAD2_T01
caggatccatgggtgcaggtggaagaatgcaagtgtctaccccctccaaaaagtctgaaaccgacaacatcaagcgcgtaccctgcgagacaccgcccttcactgtcggagaactcaagaaagcaatcccaccgcactgtttcaaacgctcgatccctccctctttctcctacctcatctgggacatcatcatagcctcctgcttctactacgtcgccaccacttacttccctctcctccctcaccctctctcctacttctggcctctctactgggcctgccatggctgcgtcctaaccggcgtctgggtcatatcccgcgagtgcggccaccacaccatcagcaactac

SEQ ID NO: 5989 - DNA, 351 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccagggctgcgtcctaaccggcgtctgggtcatagcccacgagtgcggccaccacgccttcagcgactac

SEQ ID NO: 5990 - DNA, 348 bp, Artificial
  Mutation in BnaA.FAD2.a introduced by TALE nuclease pair BnFAD2_T01
caggatccatgggtgcaggtggaagaatgcaagtgtctcctcactccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 5991 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaaatctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 5992 - DNA, 355 bp, Artificial
  Mutation in BnaA.FAD2.a introduced by TALE nuclease pair BnFAD2_T01
caggatccatgggtgcaggtggaagaatgcaagtgtctcctccccccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccaagggtgcgtcctaaccggcgtctgggtcatagcccacgagtgcggccaccacgccttcagcgactac

SEQ ID NO: 5993 - DNA, 357 bp, Artificial
  Mutation in BnaA.FAD2.a introduced by TALE nuclease pair BnFAD2_T01
caggatccatgggtgcaggtggaagaatgcaagggtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcgcgcctggcctctctactgggcctgccagggctgcgtcctaaccggcgtctgggtcatagcccacgagtgcggccaccacaccctcagcgactac

SEQ ID NO: 5994 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccagggctgcgtcctaaccggcgtctgggtcatagcccacgagtgcggccaccacgccttcagcgactac

SEQ ID NO: 5995 - DNA, 346 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccatggcctctctactgggcctgccagggctgcgtcctaaccggcgtctgggtcatagcccacgagtgcggccaccacgccttcagcgactac

SEQ ID NO: 5996 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctttggcctctctactgggcctgccaagggtgcgtcctaaccggcgtctgggtcatagcccacgagtgcggccaccacgccttcagcgactac

SEQ ID NO: 5997 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccagggctgcgtcctaaccggcgtctgggtcatagcccacgagtgcggccaccacgccttcagcgactac

SEQ ID NO: 5998 - DNA, 347 bp, Artificial
  Mutation in BnaA.FAD2.a introduced by TALE nuclease pair BnFAD2_T01
caggatccatgggtgcaggtggaagaatgcaagtgtctcctccctccacaacgtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctctccctctctcctacttgcctctctactgggcctgccaagggtgcgtcctaaccggcgtctgggtcatagcccacgagtgcggccaccacgccttcagcgactac

SEQ ID NO: 5999 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctccccctctctcctacttcctggcctctctactgggcctgccagggctgcgtcctaaccggcgtctgggtcatagcccacgagtgcggccaccacgccttcagcgactac

SEQ ID NO: 6000 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctcgcctctctactgggcctgccagggctgcgtcctaacgggcctctgggtcatcgcccacgaatgcggccaccacgccttcagcgactac

SEQ ID NO: 6001 - DNA, 380 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacaggggtccggcgcacgcgctctggaggcctgcctctctactgggcctgccagggctgcgtcctaaccggcgtctgggtcatagcccacgagtgcggccaccacgccttcagcgactac

SEQ ID NO: 6002 - DNA, 350 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccttcagcgactac

SEQ ID NO: 6003 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcgctgtttcaaacgctcgatccctcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgccttcagcgactac

SEQ ID NO: 6004 - DNA, 356 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctaccccatctgggacatcatcatagcctcctgcttctactacgtcgccaccacttacttccctctcctccctcaccctctctcctacttcgccgcctggcctctctactgggcctgccacgggtgcgtcctaaccggcgtctgggtcatagcccacgagtgcggccaccacgccttcagcgactac

SEQ ID NO: 6005 - DNA, 335 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctcctctctactgggcctgccagggctgcgtcctaaccggcgtctgggtcatagcccacgagtgcggccaccacgccttcagcgactac

SEQ ID NO: 6006 - DNA, 343 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctcccctgcctctctactgggcctgccagggctgcgtcctaaccggcctctgggtcatagcccacgagtgcggccaccacgccttcagcgactac

SEQ ID NO: 6007 - DNA, 348 bp, Artificial
  Mutation in BnaA.FAD2.a introduced by TALE nuclease pair BnFAD2_T01
caggatccatgggtgcaggtggaagaatgcaagtgtctcctccctctaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 6008 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctccatccctcgctctttctcctacctcatctgggacatcatcatagcctccttcttctactccctcgccaccacttacttccctctcctccctcaccctctctcctattggcctctctactgggcctgccaagggtgcgtcctaaccggcgtctgggtcatagcccacgagtgcggccaccacgccttcagcgactac

SEQ ID NO: 6009 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaggaaagcaatcccaccgcactgtttcaaacgctcgatccctcgctctttctcctacctcatctgggacatcatcatagcctcctgcttctactacgtcgccaccacttacttccctctcctccctcaccctctctcctactcttggcctctctactgggcctgccagggctgcgtcctaaccggcgtctgggtcatagcccacgagtgcggccaccacgccatcagcgactac

SEQ ID NO: 6010 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccagggctgcgtcctaaccggcgtctgggtcatagcccgcgagtgcggccaccactccgtcagcgactac

SEQ ID NO: 6011 - DNA, 356 bp, Artificial
  Mutation in BnaA.FAD2.a introduced by TALE nuclease pair BnFAD2_T01
caggatccatgggtgcaggtggaagtatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccacgccttcagcgactac

SEQ ID NO: 6012 - DNA, 332 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctgggcctgccagggctgcgtcctaaccggcgtctgggtcatagcccacgagtgcggccaccacgccttcagcgactac

SEQ ID NO: 6013 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctagatccctcgctctttctcctacctcatctgggacatcatcatagcctcctgcttctactacgtcgccaccacttacttccctctcctccctcaccctctctcctactcctctctactgggcctgccagggctgcgtcctaaccggcgtctgggtcatagcccacgagtgcggccaccacgccttcagcgactac

SEQ ID NO: 6014 - DNA, 342 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccagggctgcgtcctaaccggcgtctgggtcatagcccacgaatgcggccaccacgccttcagcgactac

SEQ ID NO: 6015 - DNA, 354 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccaccccctctctcctacttcgtggtggcctctctactgggcctgccaaggctgcgtcctaacgggcctctgggtcatcgcccacgaatgcggccaccacgccctcagcgactac

SEQ ID NO: 6016 - DNA, 342 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctcctctctactgggcctgccagggctgcgtcctaaccggcgtctgggtcatagcccacgagtgcggccaccacgccttcagcgactac

SEQ ID NO: 6017 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccccctcccttacctggcccctctactgggcctgccaaggctgcgtcctaacgggcctctgggtcatcgcccacgaatgcggccaccacgccttcagcgactac

SEQ ID NO: 6018 - DNA, 347 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctatcctccctcaccctctctcctactggcctctctactgggcctgccagggctgcgtcctaacgggcctctgggtcatagcccacgagtgcggccaccacgccttcagcgactac

SEQ ID NO: 6019 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgggcctgccagggctgcgtcctaacgggcctctgggtcatagcccacgagtgcggccaccacgccttcagcgactac

SEQ ID NO: 6020 - DNA, 389 bp, Artificial
  Mutation in BnaA.FAD2.a introduced by TALE nuclease pair BnFAD2_T01
caggatccatgggtgcaggttgaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgttgccgccatcgtggctggcgatggccaccacctgctggggggtcaagccgtgggcctgccaagggtgcgtcctaaccggcgtctgggtcatagcccacgagtgcggccaccacgccttcagcgactac

SEQ ID NO: 6021 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgtgtcctaaccggcgtctgggtcatagcccacgagtgcggccaccacgccttcagcgactac

SEQ ID NO: 6022 - DNA, 357 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgcccgcctggcctctctactgggcctgccaagggtgcgtcctaaccggcgtctgggtcatagcccacgagtgcggccaccacgccttcagcgactac

SEQ ID NO: 6023 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaacgggcctctgggtcatcgcccacgagtgcggccaccacgccttcagcgactac

SEQ ID NO: 6024 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacttggcctctctactgggcctgccagggctgcgtcctaaccggcgtctgggtcatagcccacgagtgcggccaccacgccttcagcgactac

SEQ ID NO: 6025 - DNA, 318 bp, Artificial
  Mutation in BnaA.FAD2.a introduced by TALE nuclease pair BnFAD2_T01
caggatccatgggtgcaggtgtaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttggcaggcctctctactgggcctgccaagggtgcgtcctaaccggcgtctgggtcatagcccacgagtgcggccaccacgccttcagcgactac

SEQ ID NO: 6026 - DNA, 343 bp, Artificial
  Mutation in BnaA.FAD2.a introduced by TALE nuclease pair BnFAD2_T01
caggatccatgggtgcagggggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctgccgctctacggggcctgccagggctgcgtcctaaccggcgtctgggtcatagcccacgagtgcggccaccacgccatcagcgactac

SEQ ID NO: 6027 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 6028 - DNA, 354 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaatcaatcccaccgcactgtttcaaacgctcgatccctcgctccttctcctacctcatctgggacatcatcatagcctcctgcttctactacgtcgccaccacttacttccctctcctccctcaccctctctcctacttcgtggtggcctctctactgggcctgccagggctgcgtcctaaccggcgtctgggtcatagcccacgagtgcggccaccacgccttcagcgactac

SEQ ID NO: 6029 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgtgcctgccagggctgcgtcctaaccggcgtctgggtcatagcccacgagtgcggccaccacgccttcagcgactac

SEQ ID NO: 6030 - DNA, 340 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggaaacctcaagaaagcaatcccacctcactgcttcaaacgctccatccctcgctccttctcctacctcatctgggacatcatcatagcctcctgcttctactacgtcgccaccacttacttccctctcctccctcaccctctctcctgctttactgggcctgccagggctgcgtcctaaccggcgtctgggtcatagcccgcgagtgcggccaccacgccatcagcgactac

SEQ ID NO: 6031 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctattgggcctgccagggctgcgtcctaaccggcgtctgggtcatagcccacgagtgcggccaccacgccttcagcgactac

SEQ ID NO: 6032 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatatcccgcgagtgcggccaccacgccttcagcgactac

SEQ ID NO: 6033 - DNA, 342 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccagggtgcgtcctaaccggcgtctgggtcatagcccacgagtgcggccaccacgccatcagcgactac

SEQ ID NO: 6034 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccttcgctctttctcctacctcatctgggacatcatcatagcctcctgcttctactacgtcgccaccacttacttccctctcctccctcaccctctctcctacaggcctctctactgggcctgccagggctgcgtcctaaccggcgtctgggtcatagcccacgagtgcggccaccacgccttcagcgactac

SEQ ID NO: 6035 - DNA, 434 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcggctgttgccggtgctgtgccaggcccacggcttgaccccccagcaggtggtggccatcgccagcaatggcggtggcaagcaggcgctggaggcctggcctctctactgggcctgccagggctgcgtcctaaccggcgtctgggtcatagcccacgagtgcggccaccacgccttcagcgactac

SEQ ID NO: 6036 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcgtagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 6037 - DNA, 429 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgggcgtcctgcccgccaccctccgggccgttgcttcacaccatcgtggctggcgatggccaccacctgctccggggtcatggcctctctactgggcctgccagggctgcgtcctaaccggcgtctgggtcatagcccacgagtgcggccaccacgccttcagcgactac

SEQ ID NO: 6038 - DNA, 312 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccaccattcactctcggagacctcaagaaagcaatcccacctcactgcttcaaacgctccatcccacgctccttctcctcttcgacatcatcatctcctcctcggctcctccctcaccctctctcctacttggcctctctactgggcctgccagggctgcgtcctaaccggcgtctgggtcatagcccacgagtgcggccaccacgccttcagcgactac

SEQ ID NO: 6039 - DNA, 332 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcatagcccacgaatgcggccaccacgccttcagcgactac

SEQ ID NO: 6040 - DNA, 357 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccccttcccccgcctggcctctctactgggcctgccaagggtgcgtcctaaccggcgtctgggtcatagcccacgagtgcggccaccacgccttcagcgactac

SEQ ID NO: 6041 - DNA, 348 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcatacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccgcgccatcagcgactac

SEQ ID NO: 6042 - DNA, 349 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctattacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 6043 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccctctctactgggcctgccagggctgcgtcctaaccggcgtctgggtcatagcccacgagtgcggccaccacgccttcagcgactac

SEQ ID NO: 6044 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcttggcctctctactgggcctgccaagggtgcgtcctaaccggcgtctgggtcatagcccacgagtgcggccaccacgccttagcgactac

SEQ ID NO: 6045 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctacgcctctctactgggcctgccagggctgcgtcctaaccggcgtctgggtcatagcccacgagtgcggccaccacgccttcagcgactac

SEQ ID NO: 6046 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcgaacgctcgatccctcgctctttctcctacctcatctgggacatcatcatagcctcctgcttctactacgtcgccaccacttacttccctctcctccctcaccctcctctctactgggcctgccaagggtgcgtcctaaccggcgtctgggtcatagcccacgagtgcggccaccacgccttcagcgactac

SEQ ID NO: 6047 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccacactgtttcaaacgctcgatccctcgctctttctcctacctcatctgggacatcatcatagcctcctgcttctactacgtcgccaccacttacttccctctcctccctcaccctctctcctaggcctctctactgggcctgccagggctgcgtcctaacgggcctctgggtcatagcccacgagtgcggccaccacgccttcagcgactac

SEQ ID NO: 6048 - DNA, 342 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctctactgggcctgccaagggtgcgtcctaaccggcctctgggtcatagcccacgagtgcggccaccacgccttcagcgactac

SEQ ID NO: 6049 - DNA, 349 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaaccggcgtctgggtcatagcccacgagtgcggccaccacgccttcagcgactac

SEQ ID NO: 6050 - DNA, 354 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctacttctacaacgtcgccaccacttacttccctctcctccctcaccctctctcctacttcgtggtggcctctctactgggcctgccaagggtgcgtcctaaccggcgtctgggtaatagcccacgagtgcggccaccacgccttcagcgactac

SEQ ID NO: 6051 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccagggctgcgtcctaaccggcgtctgggtcatagcccgcgagtgcggccaccacgccttcagcgactac

SEQ ID NO: 6052 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctggcctctctactgggcctgccagggctgcgtcctaaccggcgtctgggtcatagcccacgagtgcggccaccacgccttcagcgactac

SEQ ID NO: 6053 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccccttcggctctctactgggcctgccagggctgcgtcctaaccggcgtctgggtcatagcccacgagtgcggccaccacgccttcagcgactac

SEQ ID NO: 6054 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtcggaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgctggcctctctactgggcctgccagggctgcgtcctaaccggcgtctgggtcatagcccacgagtgcggccaccacgccttcagcgactac

SEQ ID NO: 6055 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgtgacatcatcatagcctcctgcttctactacgtcgccaccacttacttccctctcctccctcaccctctctcctacttctgggcctctctactgggcctgccaagggtgcgtcctaaccggcgtctgggtcatagcccacgagtgcggccaccacgccttcagcgactac

SEQ ID NO: 6056 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctgccaagggtgcgtcctaacgggcctctgggtcatagcccacgagtgcggccaccacgccttcagcgactac

SEQ ID NO: 6057 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgccaagggtgcgtcctaacgggcctctgggtcatagcccacgagtgcggccaccacgccttcagcgactac

SEQ ID NO: 6058 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctaccacctctccacagcctacttccctctcctcccccaccctctccctggcccctctactgggcctgccaagggtgcgtcctaaccggcgtctgggtcatagcccacgagtgcggccaccacgccttcagcgactac

SEQ ID NO: 6059 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttccctctctactgggcctgccagggctgcgtcctaaccggcgtctgggtcatagcccacgagtgcggccaccacgccttcagcgactac

SEQ ID NO: 6060 - DNA, 344 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctatcctctctactgggcctgccagggctgcgtcctaaccggcgtctgggtcatagcccacgagtgcggccaccacgccttcagcgactac

SEQ ID NO: 6061 - DNA, 356 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccagggctgcgtcctaaccggcgtctgggtcatagcccacgagtgcggccaccacgccttcagcgactac

SEQ ID NO: 6062 - DNA, 354 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtggtggcctctctactgggcctgccaaggctgcgtcctaaccggcgtctgggtcatagcccacgagtgcggccaccacgccttcagcgactac

SEQ ID NO: 6063 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccccccctccgccggcctctctactgggcctgccagggctgcgtcctaaccggcgtctgggtcatagcccacgagtgcggccaccacgccttcagcgactac

SEQ ID NO: 6064 - DNA, 356 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctccgccgcctggcctctctactgggcctgccagggctgcgtcctaaccggcgtctgggtcatagcccacgagtgcggccaccacgccttcagcgactac

SEQ ID NO: 6065 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctaggcctctctactgggcctgccagggctgcgtcctaaccggcgtctgggtcatagcccacgagtgcggccaccacgcctgcagcgactac

SEQ ID NO: 6066 - DNA, 338 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactactgggcctgccagggctgcgtcctaaccggcgtctgggtcatagcccacgagtgcggccaccacgccttcagcgactac

SEQ ID NO: 6067 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgctccctcgctctttctcctacctcatctgggacatcatcatagcctcctgcttctactacgtcgccaccacttacttccctctcctccctcaccctctctcctacatcctctctactgggcctgccagggctgcgtcctaaccggcgtctgggtcatagcccacgagtgcggccaccacgccttcagcgactac

SEQ ID NO: 6068 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccctggcctctctactgggcctgccagggctgcgtcctaaccggcgtctgggtcatagcccacgagtgcggccaccacgccttcagcgactac

SEQ ID NO: 6069 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgcctctctactgggcctgccagggctgcgtcctaaccggcctctgggtcatagcccacgagtgcggccaccacgccttcagcgactac

SEQ ID NO: 6070 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccaagggtgcgtcctaaccggcgtctgggtcatagcccacgagtgcggccaccacgccttcatcgactac

SEQ ID NO: 6071 - DNA, 356 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacttcgccgcctggcctctctactgggcctgccaaggctgcgtcctaacgggcctctgggtcatagcccacgagtgcggccaccacgccttcagcgactac

SEQ ID NO: 6072 - DNA, 386 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctccccttcttggccaccacctgctggggggtcaagccgtgggcctggcacagtctctactgggcctgccagggctgcgtcctaaccggcgtctgggtcatagcccacgagtgcggccaccacgccttcagcgactac

SEQ ID NO: 6073 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctctactgggcctgccaagggtgcgtcctaaccggcgtctgggtcatagcccacgagtgcggccaccacgccttcagcgactac

SEQ ID NO: 6074 - DNA, 349 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttcgactacgtcgccaccacttactttcctctcctccctcaccctctctcctactttggcctctctactgggcctgccagggctgcgtcctaaccggcgtctgggtcatagcccacgagtgcggccaccacgccttcagcgactac

SEQ ID NO: 6075 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgctagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggcctgccagggctgcgtcctaaccggcgtctgggtcatagcccacgagtgcggccaccacgccttcagcgactac

SEQ ID NO: 6076 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgacaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccaagggtgcgtcctaaccggcgtctgggtcatagcccacgagtgcggccaccacgccgtcagcgactac

SEQ ID NO: 6077 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctggcctctctactgggcctgccaagggtgcgtgctaaccggcgtctgggtcatagcccacgagtgcggccaccacgccttcagcgactaa

SEQ ID NO: 6078 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgagtgcggccaccacgcctcagcgactac

SEQ ID NO: 6079 - DNA, 332 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccagggctgcgtcctaaccggcgtctgggtcatagcccacgagtgcggccaccacgccttcagcgactac

SEQ ID NO: 6080 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggtctctctactgggcctgccagggctgcgtcctaaccggcgtctgggtcatagcccacgagtgcggccaccacgccttcagcgactac

SEQ ID NO: 6081 - DNA, 351 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgcggcctatctactgggcctgccagggctgcgtcctaaccggcgtctgggtcatagcccacgagtgcggccaccacgccttcagcgactac

SEQ ID NO: 6082 - DNA, 340 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttactaccctctcctccctcaccctctctcctactctactgggcctgccagggctgcgtcctaaccggcgtctgggtcatagcccacgagtgcggccaccacgccttcagcgactac

SEQ ID NO: 6083 - DNA, 349 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccctcagcgactac

SEQ ID NO: 6084 - DNA, 352 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttacccccctggcccctctactgggcctgccaaggctgcgtcctaacgggcctctgggtcatcgcccacgaatgcggccaccacgccttcagcgactac

SEQ ID NO: 6085 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctctctactgggcctgccagggctgcgtcctaaccggcgtctgggtcatagcccacgagtgcggccaccacgccttcagcgactac

SEQ ID NO: 6086 - DNA, 325 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctacgagacaccaccattcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttggctgcgtcctaaccggcgtctgggtcatagcccacgagtgcggccaccacgccttcagcgactac

SEQ ID NO: 6087 - DNA, 349 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 6088 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcgaagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccagggctgcgtcctaaccggcgtctgggtcatagcccacgagtgcggccaccacgccttcagcgactac

SEQ ID NO: 6089 - DNA, 348 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgcctgcagcgactac

SEQ ID NO: 6090 - DNA, 342 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttctactgggcctgccagggctgcgtcctaaccggcgtctgtgtcatagcccacgagtgcggccaccacgccttcagcgactac

SEQ ID NO: 6091 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcatctctactgggcctgccagggctgcgtcctaaccggcgtctgggtcatagcccacgagtgcggccaccacgccttcagcgactac

SEQ ID NO: 6092 - DNA, 346 bp, Artificial
  Mutation in BnaA.FAD2.a introduced by TALE nuclease pair BnFAD2_T01
caggatctgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 6093 - DNA, 335 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccagggctgcgtcctaaccggcgtctgggtcatagcccacgagtgcggccaccacgcctgcagcgactac

SEQ ID NO: 6094 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcagctggcctctctactgggcctgccaagggtgcgtcctaaccggcgtctgggtcatagcccacgagtgcggccaccacgccttcagcgactac

SEQ ID NO: 6095 - DNA, 347 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctaatggcctctctactgggcctgccagggctgcgtcctaaccggcgtctgggtcatagcccacgagtgcggccaccacgccttcagcgactac

SEQ ID NO: 6096 - DNA, 334 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctactgggcctgccagggctgcgtcctaacgggcctctgggtcatcgcccacgaatgcggccaccacgccttcagcgactac

SEQ ID NO: 6097 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcacaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccaagggtgcgtcctaaccggcgtctgggtcatagcccacgagtgcggccaccacgccttcagcgactac

SEQ ID NO: 6098 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctggcctctctactgggcctgccaagggtgcgtcctaaccggcgtctgggtcatagcccacgagtgcggccaccacgccttcagcgactac

SEQ ID NO: 6099 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctagcctggcctctctacggggcctgccaagggtgcgtcctaacgggcctctgggtcatagcccacgagtgcggccaccacgccttcagcgactac

SEQ ID NO: 6100 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccatcagcgactac

SEQ ID NO: 6101 - DNA, 332 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccatgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactgggcctgccaagggtgcgtcctaaccggcgtctgggtcatagcccacgagtgcggccaccacgccttcagcgactac

SEQ ID NO: 6102 - DNA, 334 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcacccactctctactgggcctgccagggctgcgtcctaaccggcgtctgggtcatatcccacgagtgcggccaccacgccttcagcgactac

SEQ ID NO: 6103 - DNA, 340 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctcttcgacatcatcatctcctcctcggctcctccctctaccacctctccacagcctacttccctctcctccctcaccctctctcctacttactgggcctgccagggctgcgtcctaaccggcgtctgggtcatagcccacgagtgcggccaccacgccttcagcgactac

SEQ ID NO: 6104 - DNA, 323 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctcgagccacccactgggcctgccaagggtgcgtcctaaccggcgtctgggtcatagcccacgagtgcggccaccacgccatcagcgactac

SEQ ID NO: 6105 - DNA, 276 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacataagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcacgccctcagcgactac

SEQ ID NO: 6106 - DNA, 357 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctactacttcgcgcgcctggcctctctactgggcctgccagggctgcgtcctaaccggcgtctgggtcatagcccacgagtgcggccaccacgccttcagcgactac

SEQ ID NO: 6107 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcccctctactgggcctgccaaggctgcgtcctaacgggcctctgggtcatcgcccacgaatgcggccaccacgccttcagcgactac

SEQ ID NO: 6108 - DNA, 338 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctattactgggcctgccagggctgcgtcctaaccggcgtctgggtcatagcccacgagtgcggccatcacgccttcagcgactac

SEQ ID NO: 6109 - DNA, 344 bp, Artificial
  Mutation in BnaA.FAD2.a introduced by TALE nuclease pair BnFAD2_T01
caggatccatgggtgcaggtggaagaatgcaagtggctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatcctctctactgggcctgccagggctgcgtcctaaccggcgtctgggtcatagcccacgagtgcggccaccacgccatcagcgactac

SEQ ID NO: 6110 - DNA, 387 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccccggagcaggtggtggccatcgccagccacgatggcgcctggcctctctactgggcctgccagggctgcgtcctaacgggcctctgggtcatcgcccacgaatgcggccaccacgccttcagcgactac

SEQ ID NO: 6111 - DNA, 345 bp, Artificial
  Mutation in BnaA.FAD2.a introduced by TALE nuclease pair BnFAD2_T01
caggatccatgggtgcaggtggaagaatgcaagtgactcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccctggcctctctactgggcctgccagggctgcgtcctaaccggcgtctgggtcatagcccacgagtgcggccaccacgccttcagcgactac

SEQ ID NO: 6112 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccgcgcggcctctctactgggcctgccagggctgcgtcctaaccggcgtctgggtcatagcccacgagtgcggccaccacgccttcagcgactac

SEQ ID NO: 6113 - DNA, 350 bp, Artificial
  Mutation in BnaA.FAD2.a introduced by TALE nuclease pair BnFAD2_T01
caggatccatgggtgcaggtggaagaatgcaagtgtctcctccatccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccaagggtgcgtcctaaccggcgtctgggtcatagcccacgagtgcggccaccacgccttcagcgactac

SEQ ID NO: 6114 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactggcctctctactgggcctgccagggctgcgtcctaacgggcctctgggtcatagcccacgagtgcggccaccacgccttcagcgactac

SEQ ID NO: 6115 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacctggcctctctactgggcctgccagggctgcgtcctaaccggcgtctgggtcatagcccacgagtgcggccaccacgccttcagcgactac

SEQ ID NO: 6116 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaataccaccgcactgtttcaaacgctcgatccctcgctctttctcctacctcatctgggacatcatcatagcctcctgcttctactacgtcgccaccacttacttccctctcctccctcaccctctctcctacttgggcctctctactgggcctgccaagggtgcgtcctaaccggcgtctgggtcatagcccacgagtgcggccaccacgccttcagcgactac

SEQ ID NO: 6117 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttgcctctctactgggcctgccagggctgcgtcctaaccggcgtctgggtcatagcccacgagtgcggccaccacgccttcagcgactac

SEQ ID NO: 6118 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccaagggtgcgtcctaaccggcgtctgggtcatcgcccacgaatgcggccaccacgccttcagcgactac

SEQ ID NO: 6119 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcgccctctcacctactttggccgctctactgggcctgccaagggtgcgtcctaaccagcgtctggggcatatccgaggagtgcggccaccacgccatcagcgactac

SEQ ID NO: 6120 - DNA, 356 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccacgcctgcagcgactac

SEQ ID NO: 6121 - DNA, 324 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctactgcttctactacgtcgccaccacttacttccctctcctccctcaccctctctcgccaagggtgcgtcctaaccggcgtctgggtcatagcccacgagtgcggccaccacgccttcagcgactac

SEQ ID NO: 6122 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctaccagggctgcgtcctaaccggcgtctgggtcatagcccacgagtgcggccaccacgccttcagcgactac

SEQ ID NO: 6123 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgccttggcctctctactaggcctaccaggactgcgtcctaaccggcgtctgggtcatagcccacgagtgcggccaccacgccttcagcgactac

SEQ ID NO: 6124 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccagggctgcgtcctaaccggcgtctgggtcatagcccacgagtgcggccaccacgccttcagcgactac

SEQ ID NO: 6125 - DNA, 426 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccacccttcactctcggagacctcaagaaagcaatcccacctcactgcttcaaacgctccatccctcgctccttctcctacctcatctgggacatcatcatagcctcctgcttctactacgtcgccaccacttacttccctctcctccctcaccctctctcctacttatggacgccaactacctctgatagttgagtcgatacttcggcgatcaccgcttccctcataatgtttaactttgttttggcctctctactgggcctgccagggctgcgtcctaaccggcgtctgggtcatagcccacgagtgcggccaccacgccttcagcgactac

SEQ ID NO: 6126 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccactgcgtggcctctctactgggcctgccagggctgcgtcctaaccggcgtctgggtcatagcccacgagtgcggccaccacgccttcagcgactac

SEQ ID NO: 6127 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctatcctccctcaccctctctcctacttggcctctctactgggcctgccagggctgcgtcctaaccggcgtctgggtcatagcccacgagtgcggccaccacgccttcagcgactac

SEQ ID NO: 6128 - DNA, 325 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactaaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggctgcgtcctaaccggcctctgggtcatagcccacgagtgcggccaccacgccttcagcgactac

SEQ ID NO: 6129 - DNA, 348 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcataccctgcgagacaccgcccttcactgtcggagaactcaagaaagcaatcccaccgcactgtttcaaacgctcgatccctcgctctttctcatacctcatctgggacatcatcatagcctcctgcttctactacgtcgccaccacttacttccctctcctccctcaccctctctcctacttggcctctctactgggcctgccaagggtgcgtcctaaccggcgtctgggtcatagcccacgagtgcggccaccacgccttcagcgactac

SEQ ID NO: 6130 - DNA, 430 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccgacggagggacggccagaaacggcggtgcgagagggcgctcgatgacgccaacgatggccaccacctgctccggggtcaagccagttggcctctctactgggcctgccagggctgcgtcctaacgggcctctgggtcatagcccacgagcgcggccaccacgccttcagcgactcc

SEQ ID NO: 6131 - DNA, 449 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcacatacttcgccaggcccacggcgtgaccccccagcaggtggtggccatcgccagcaatggcggtggcgaacaggcgctggagacggtccagcggctgttgccggtgctggcctctctactgggcccgccagggctgcgtcctaaccggcgtctgggtcatagcccacgagtgcggccaccacgccttcagcgactac

SEQ ID NO: 6132 - DNA, 407 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgacaaacaacagataaaacgaaaggcccagtcttcgctcgtcaggggggcggagccctggcctctctactgggcctgccaagggtgcgtcctaaccggcgtctgggtcatagcccacgagtgcggccaccacgccttcagcgactac

SEQ ID NO: 6133 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctggcctctctactgggcctaccagggctgcgtcctaaccggcgtctgggtcatagcccacgagtgcggccaccacgccttcagcgactac

SEQ ID NO: 6134 - DNA, 339 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaccatcaagcgcgtaccctacgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctactgggcctgccagggctgcgtcctaaccggcgtctgggtcatagcccacgagtgcggccaccacgccttcagcgactac

SEQ ID NO: 6135 - DNA, 345 bp, Artificial
  Mutation in BnaA.FAD2.a introduced by TALE nuclease pair BnFAD2_T01
caggatccatgggtgcaggtggaagaatgcaagtgtctcctcactccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgcaagggctgcgtcctaacgggcctctgggtcatcgcccacgaatgcggccaccacgccttcagcgactac

SEQ ID NO: 6136 - DNA, 340 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctctcctactctactgggccggccagggctgcgtcctaaccggcgtctgggtcatagccctcgagtgctgccaccacgccttcagcgactac

SEQ ID NO: 6137 - DNA, 352 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactccgctggcctctctactgggcctgccagggctgcgtcctaaccggcgtctgggtcatcgcccacgaatgcggccaccacgccttcagcgactac

SEQ ID NO: 6138 - DNA, 351 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctggcctctactgggcctgccagggctgcgtcctaaccggcgtctgggtcatagcccacgagtgcggccaccacgccttcagcgactac

SEQ ID NO: 6139 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcctctctactgggcctgtcagggctgcgtcctaaccggcgtctgggtcatagcccacgagtgcggccaccacgccttcagcgactac

SEQ ID NO: 6140 - DNA, 390 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgctggcggtggcaagcacctgctggggggtcaagccgtgggcggcctctctactgggcctgccaagggtgcgtcctaaccggcgtctgggtcatagcccacgaatgcggccaccacgccttcagcgactac

SEQ ID NO: 6141 - DNA, 356 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccagggctgtgtcctaaccggcgtctgggtcatagcccacgagtgcggccaccacgccttcagcgactac

SEQ ID NO: 6142 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccctggcctctctactgggcctgccaaggctgcgtcctaacgggcctctgggtcatcgcccacgaatgcggccaccacgccttcagcgactac

SEQ ID NO: 6143 - DNA, 300 bp, Artificial
  Mutation in BnaA.FAD2.a introduced by TALE nuclease pair BnFAD2_T01
caggatccatgggtgcaggtggaagaatgcaagtgtctaatccctccaaaaagtctgaaaccgacaacatcaagcgcgtaccctgcgagacaccgcccttcactgtcggagaactcaagaaagcaatcccaccgcactgtttcaaacgctcgatccctcgccctttctcctacctcatctgggacatcatcatagcctcctgcttctactacgtctctctactgggcctgccaagggtgcgtcctaacgggcctctgggtcatcgcccacgaatgcggccaccacgccttcagcaactac

SEQ ID NO: 6144 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggcggcgtcctaaccggcgtctgggtcatagcccacgagtgcggccaccacgccttcagcgactac

SEQ ID NO: 6145 - DNA, 356 bp, Artificial
  Mutation in BnaA.FAD2.a introduced by TALE nuclease pair BnFAD2_T01
caggatccatgggtgcaggtgcaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctggtacatcatcatagcctcctgcttctactacgtcgccaccacttacttccctctcctccctcaccctctctcctacttcgccgcctggcctctctactgggcctgccagggctgcgtcctaacgggcctctgggtcatcgcccacgaatgcggccaccacgccttcagcgactac

SEQ ID NO: 6146 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccgccctggcctctctactgggcctgccagggctgcgtcctaaccggcgtctgggtcatagcccacgagtgcggccaccacgccttcagcgactac

SEQ ID NO: 6147 - DNA, 339 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctctctactgggcctgccagggctgcgtcctaaccggcgtctgggtcatcgcccacgaatgcggccaccacgccttcagcgactac

SEQ ID NO: 6148 - DNA, 348 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 6149 - DNA, 352 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgctggcctctctactgggcctgccagggctgcgtcctaaccggcgtctgggtcatagcccacgagtgcggccaccacgccttcagcgactac

SEQ ID NO: 6150 - DNA, 340 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttactgggcctgccagggctgcgtcctaaccggcgtctgggtcatagcccacgagtgcggccaccacgccttcagcgactac

SEQ ID NO: 6151 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacggcctctctactgggcctgccaagggtgcgtcctaaccggcgtctgggtcatcgcccacgaatgcggccaccacgccttcagcgactac

SEQ ID NO: 6152 - DNA, 335 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaacacaagaaagcaatcccaccgcactgtttcaaacgctcgatccctcgctctttctcctacctcatctgggacatcatcatagcctcctgcttctactacgtcgccaccacttacttccctctcctccctcaccatctctcctactgggcctgccagggctgcgtcctaaccggcgtctgggtcatagcccacgagtgcggccaccacgccttcagcgactac

SEQ ID NO: 6153 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctggcctctctacggggcctgccatggctgcgtcctaaccggcgtctgggtcatagcccacgagtgcggccaccacgccttcagcgactac

SEQ ID NO: 6154 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcttaaccggcgtctgggtcatagcccacgagtgcggccaccacgccttcagcgactac

SEQ ID NO: 6155 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctccatccctcgctctttctcctacctcatctgggacatcatcatagcctcctgcttctactacgtcgccaccacttacttccctctcctccctcaccctctctcctatggcctctctactgggcctgccagggctgcgtcctaaccggcgtctgggtcatagcccacgagtgcggccaccacgccttcagcgactac

SEQ ID NO: 6156 - DNA, 347 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcgcctctctactgggcctgccagggctgcgtcctaaccggcgtctgggtcatagcccacgagtgcggccaccacgccttcagcgactac

SEQ ID NO: 6157 - DNA, 339 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctacttactgggcctgccagggctgcgtcctaaccggcgtctgggtcatagcccacgagtgcggccaccacgccttcagcgactac

SEQ ID NO: 6158 - DNA, 417 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgtcaggacatgatcgcagcgttgccagagcgagattctccgcgctgtagaagtcaccattgttgtgctggcctctctactgggcctgccagggctgcgtcctaaccggcgtctgggtcatagcccacgagtgcggccaccacgccttcagcgactac

SEQ ID NO: 6159 - DNA, 345 bp, Artificial
  Mutation in BnaA.FAD2.a introduced by TALE nuclease pair BnFAD2_T01
caggatccatgggtgcaggtggaagaatgcaagtgtctcctcactccaaaaagtctgaaaccgacaacatcaagcgcgtaccctgcgagacaccgcccttcactgtcggagaactcaagaaagcaatcccaccgcactgtttcaaacgctcgatccatcgctctttctcctacctcatctgggacatcatcatagcctcctgcttctactacgtcgccaccacttacttccctctcctccctcaccctctctcctaggcctctctactgggcctgccaagggtgcgtcctaaccggcgtctgggtcatagcccacgagtgcggccaccacgccttcagcgactac

SEQ ID NO: 6160 - DNA, 449 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccaggcccacggcttgaccccggagcaggtggtggccatcgccagcaatggcggtggcaagcaggcgctggagacggtccagcggctgttgccggtgctggcctctctactgggcctgccagggctgcgtcctaaccggcgtctgggtcatagcccacgagtgcggccaccacgccttcagcgactac

SEQ ID NO: 6161 - DNA, 345 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccagggctgcgtcctaaccggcgtctgggtcatcgcccacgagtgcggccaccacgccttcagcgactac

SEQ ID NO: 6162 - DNA, 423 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctcctgggccagccccccgtcttgcccccggagcaggtggggcccatcgccagccacgatggcggcaacagccgctggactggcctctctactgggcctgccagggctgcgtcctaaccggcgtctgggtcatagcccacgagtgcggccaccacgccttcagcgactac

SEQ ID NO: 6163 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccaaggctgcgtcctaacgggcctctgggtcatagcccacgagtgtggccaccacgccttcagcgactac

SEQ ID NO: 6164 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcctgggcctgccagggctgcgtcctaaccggcgtctgggtcatagcccacgagtgcggccaccacgccttcagcgactac

SEQ ID NO: 6165 - DNA, 343 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctggcctctctactgggcctgccagggctgcgtcctaaccggcctctgggtcatagcccacgagtgcggccaccacgccttcagcgactac

SEQ ID NO: 6166 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcaccatagcctcctgcttctactacgtcgccaccacttacttccctctcctccctcaccctctctcctacttttggcctctctactgggcctgccagggctgcgtcctaaccggcgtctgggtcatagcccacgagtgcggccaccacgccttcagcgactac

SEQ ID NO: 6167 - DNA, 358 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcggcgggtctggcctctctactgggcctgccagggctgcgtcctaaccggcgtctgggtcatagcccacgagtgcggccaccacgccttcagcgactac

SEQ ID NO: 6168 - DNA, 277 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcgccttcagcgactac

SEQ ID NO: 6169 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtccgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcggcctctctactgggcctgccagggctgcgtcctaaccggcgtctgggtcatagcccacgagtgcggccaccacgccttcagcgactac

SEQ ID NO: 6170 - DNA, 343 bp, Artificial
  Mutation in BnaA.FAD2.a introduced by TALE nuclease pair BnFAD2_T01
caggatccatgggtgcaggtggaagaatgcaagtgtctcctccatccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctctactgggcctgccagggctgcgtcctaaccggcgtctgggtcatagcccacgagtgcggccaccacgcctgcagcgactac

SEQ ID NO: 6171 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaaccggcgtctgggtcatagcccacgagtgcggccaccacgccgtcagcgactac

SEQ ID NO: 6172 - DNA, 343 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccagggctgcgtcctaaccggcgtctgggtcatagcccacgagtgcggccaccacgccttcagcgactac

SEQ ID NO: 6173 - DNA, 343 bp, Artificial
  Mutation in BnaA.FAD2.a introduced by TALE nuclease pair BnFAD2_T01
caggatccatgggtgcaggtgcaagaatgcaagtgtctcctccctacaaaaagtctgaaaccgacaacatcaagcgcgtaccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctgcctctctactgggcctgccgagggggcgtcctaacgggcctctgggtcatcgcccacgaatgcggccaccacgccttcagcgactac

SEQ ID NO: 6174 - DNA, 345 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgcctctctactgggcctgccagggctgcgtcctaaccggcgtctgggtcatagcccacgagtgcggccaccacgccttcagcgactac

SEQ ID NO: 6175 - DNA, 334 bp, Artificial
  Mutation in BnaA.FAD2.a introduced by TALE nuclease pair BnFAD2_T01
caggatccagggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcctctctactgggcctgacagggctgcgtcctaaccggcgtctgggtcatagcccacgagtgcggccaccacgccttcagcgactac

SEQ ID NO: 6176 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaccgccctggcctctctactgggcctgccagggctgcgtcctaacgggcctctgggtcatagcccacgagtgcggccaccacgccttcagcgactac

SEQ ID NO: 6177 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgcctggcctctctactgggcctgccagggctgcgtcctaaccggcgtctgggtcatagcccacgagtgcggccaccacgccttcagcgactac

SEQ ID NO: 6178 - DNA, 354 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctcccccaccctctcccttccctccgcctggcccctctactgggcctgccaaggctgcgtcctaacgggcctctgggtcatcgcccacgaatgcggccaccacgccttcagcgactac

SEQ ID NO: 6179 - DNA, 345 bp, Artificial
  Mutation in BnaA.FAD2.a introduced by TALE nuclease pair BnFAD2_T01
caggatccatgggtgcaggtggaagaatgcaagtgtcccctccctccaaaaagtctgaaaccgacaacatcaagcgcgtaccctgtgatacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccaagggtgcgtcctaaccggcgtctgggtcatagcccacgagtgcggccaccacgccttcagcgactac

SEQ ID NO: 6180 - DNA, 349 bp, Artificial
  Mutation in BnaA.FAD2.a introduced by TALE nuclease pair BnFAD2_T01
caggatccatgggtgcaggtgcaagaatgcaagtgtcccctccctccaagaagtctgaaaccgacaccatcaagcgcgtacccagcgagacaccgcccttcactgtcggagaactcaagaaagcaatcccaccgcactgtttaaaacgctcgatccctcgctctttctcctacctcatctgggacatcatcatagcctcctgctgctactacgtcgccaccacttgcttccctctcctccctctccctctctcctactttggcctctctactgggccttccagggctgcgtcctaaccggcgtctgggtggtagcccacgagtgctgccaccacgcctacagcgactac

SEQ ID NO: 6181 - DNA, 347 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcgctgtttcaaacgctcgatccctcgctctttctcctacctcatctgggacatcatcatagcctcctgcttctactacgtcgccaccacttacttccctctcctccctcaccctctcccctgctggcctctctacggggcctgccaagggtgcgtcctaacccgcgtctgggtcatagcccacgagtgcggccaccgcgccatgaacaactac

SEQ ID NO: 6182 - DNA, 335 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgggcctgccagggctgcgtactaaccggcgtctgggtcatagcccacgagtgcggccaccacgccttcagcgactac

SEQ ID NO: 6183 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgctttggcctctctactgggcctgccagggctgcgtcctaaccggcgtctgggtcatagcccgcgagtgcggtcaccacgccttcagcgactac

SEQ ID NO: 6184 - DNA, 408 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgagccgaagtttccaaaaggtcgttgatcaaagctcgccgcgttgtttcatcaagccttggcctctctactgggcctgccaagggtgcgtcctaaccggcgtctgggtcatagcccacgagtgcggccaccacgccttcagcgactac

SEQ ID NO: 6185 - DNA, 383 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcagcggctgttgccggtgctgtgccaggcccacggcttctctctactgggcctgccaagggtgcgtcctaaccggcgtctgggtcatagcccacgagtgcggccaccacgccttcagcgactac

SEQ ID NO: 6186 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccacccttcactctcggagacctcaagaaagcaatcccacctcactgcttcaaacgctccatcccacgctccttctcctacctcatctgggacatcatcatagcctcctgcttctactacgtcgccaccacttacttccctctcctccctcaccctctctcctggcctctctactgggcctgccagggctgcgtcctaaccggcgtctgggtcatagcccacgagtgcggccaccacgccttcagcgactac

SEQ ID NO: 6187 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctggaacatcatcatagcctcctgcttctactacgtcgccaccacttacttccctctcctccctcaccctctctcctacttgcctctctactgggcctgccagggctgcgtcctaaccggcgtctgggtcatagcccacgagtgcggccaccacgccttcagcgactac

SEQ ID NO: 6188 - DNA, 329 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctgggcctgccagggctgcgtcctaaccggcgtctgggtcatagcccacgagtgcggccaccacgccttcagcgactac

SEQ ID NO: 6189 - DNA, 345 bp, Artificial
  Mutation in BnaA.FAD2.a introduced by TALE nuclease pair BnFAD2_T01
caggatccatgggtgcaggtggaagaatgcaagtgtctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggcctgccaagggtgcgtcctaaccggcgtctgggtcatagcccacgagtgcggccaccacgccttcagcgactac

SEQ ID NO: 6190 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccagggctgtgtcctaaccggcgtctgggtcatcgcccacgaatgcggccaccacgccttcagcgactac

SEQ ID NO: 6191 - DNA, 339 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctccttcgccggcctgccagggctgcgtcctaaccggcgtctgggtcatagcccacgagtgcggccaccacgccttcagcgactac

SEQ ID NO: 6192 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatcccctctactgggcctgccagggctgcgtcctaaccggcgtctgggtcatagcccacgagtgcggccaccacgccttcagcgactac

SEQ ID NO: 6193 - DNA, 348 bp, Artificial
  Mutation in BnaA.FAD2.a introduced by TALE nuclease pair BnFAD2_T01
caggatccatgggtgcaggtggaagaatgcaagtgtctcctccatccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacgtcggcctctctactgggcctgccaagggtgcgtcctaaccggcgtctgggtcatagcccacgagtgcggccaccacgcttcagcgactac

SEQ ID NO: 6194 - DNA, 449 bp, Artificial
  Mutation in BnaA.FAD2.a introduced by TALE nuclease pair BnFAD2_T01
caggatccatgggtgcaggtggaagaatgcaagtgtctcctccatccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgccaggcccacggctggaccccggagcaggtggtggccatcaccagcaatggcggtggcaagcaggcgcgggagacggtccagcggctgttgccggtgctggcctctctactgggcctgccagggctgcgtcctaaccggcgtctgggtcatagcccacgagtgcggccaccacgccttcagcgactac

SEQ ID NO: 6195 - DNA, 357 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctcctccgcccgcctggcctctctactgggcctgccaagggtgcgtcctaaccggcgtctgggtcatcgcccacgaatgcggccaccacgccttcagcgactac

SEQ ID NO: 6196 - DNA, 355 bp, Artificial
  Mutation in BnaA.FAD2.a introduced by TALE nuclease pair BnFAD2_T01
caggatccatgggtgcaggtggaagaatgcaagtgtctcctccctcaaaaaagtctgaaaccgacaacatcaagcgcgtaccctgcgagacaccgcccttcactgtcggagaactcaagaaagcaatcccaccgcactgtttcaaacgctcgatccctcactctttctcctacctcatcggggacatcatcatagcctcctgctcctactacgtcgccaccacttacttccctctcctccctcaccctctcgcctacgtggacgctggccgctctacggggcctgccaaggctgcggcctaacgggcctgtgggtcatcgcccacgaatgcggccaccacgccatcagcgactac

SEQ ID NO: 6197 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgcctggcctctctactgggcctgccaagggtgcgtcctaaccggcgtctgggtcatagcccacgagtgcggccaccacgccttcagcgacac

SEQ ID NO: 6198 - DNA, 345 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccacctcactgcttcaaacgctcgatcactcgctctttctcctacctcatctgggacatcatcatagcctcctgcttctactacgtcgccaccacttacttccctctcctccctcaccctctctcctaggcctctctactgggcctgccagggctgcgtcctaaccggcgtctgggtcatagcccacgagtgcggccaccacgccttcagcgactac

SEQ ID NO: 6199 - DNA, 345 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccctggcctctctactgggcctgccagggctgcgtcctaaccggcgtctgggtcatagcccacgagtgcggccaccacgccttcagcgactac

SEQ ID NO: 6200 - DNA, 347 bp, Artificial
  Mutation in BnaA.FAD2.a introduced by TALE nuclease pair BnFAD2_T01
caggatccatgggtgcaggtggaagaatgcaagtgcctcctcactccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctacctctctactgggcctgccaagggtgcgtcctaaccggcgtctgggtcatagcccacgagtgcggccaccacgccttcagcgactac

SEQ ID NO: 6201 - DNA, 358 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccgggtctggcctctctactgggcctgccagggctgcgtcctaaccggcgtctgggtcatagcccacgagtgcggccaccacgccttcagcgactac

SEQ ID NO: 6202 - DNA, 347 bp, Artificial
  Mutation in BnaA.FAD2.a introduced by TALE nuclease pair BnFAD2_T01
caggatccatgggtgcaggtggaagaatgcaagtgtctcctccatccaaaaagtctgaaaccgacaaaatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcgcctctctactgggcctcccaagggtgcctcctaacctgcttctgggtcatagcccacgattgctgccaccacgccttcagcgactac

SEQ ID NO: 6203 - DNA, 345 bp, Artificial
  Mutation in BnaA.FAD2.a introduced by TALE nuclease pair BnFAD2_T01
caggatccatgggtgcaggtggaagaatgcaagtgtctcctcactccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctactgcttctactacgtcgccaccacttacttccctctcctccctcaccctctctccttggcctctctactgggcctgccaagggtgcgtcctaaccggcgtctgggtcatagcccacgagtgcggccaccacgccttcagcgactac

SEQ ID NO: 6204 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactatggcctctctactgggcctgccagggctgcgtcctgaccggcgtctgggtcatagcccacgagtgcggccaccacgccttcagcaactac

SEQ ID NO: 6205 - DNA, 342 bp, Artificial
  Mutation in BnaA.FAD2.a introduced by TALE nuclease pair BnFAD2_T01
caggatccatgggtgcaggtggaagaatgcaagtgtctcctccatccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcgcctggcctctctactgggcctgccaagggtgcgtcctaaccggcgtctgggtcatagcccacgagtgcggccaccacgccttcagcgactac

SEQ ID NO: 6206 - DNA, 335 bp, Artificial
  Mutation in BnaA.FAD2.a introduced by TALE nuclease pair BnFAD2_T01
caggatccatgggtgcaggtggaagaatgcaagtctctcctccctccaagaagtctgaaaccgacaccatcaagcgcgtaccctgcgagacaccgcccttcactgtcggagaactcaagaaagcaatcccacctcactgcttcaaacgctccatccctcgctctttctcctacctcatctgggacatcatcatagcctcctgcttctactacgtcgccaccacttacttccctctcctccctcaccctctcccctactgggcctgccagggctgcgtcctaaccggcgtctgggtcatagcccacgagtgcggccaccacgccttcagcgactac

SEQ ID NO: 6207 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccacccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccagggctgcgtcctaaccggcgtctgggtcatagcccacgagtgcggccaccacgccttcagcgactac

SEQ ID NO: 6208 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtccgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 6209 - DNA, 348 bp, Artificial
  Mutation in BnaA.FAD2.a introduced by TALE nuclease pair BnFAD2_T01
caggatccatgggtgcaggttgaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 6210 - DNA, 332 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaaaatcaagcgcgtaccctgcgagacaccgcccttcactgtcggagaactcaagaaagcaatcccaccgcactgtttcaaacgctcgatccctcgctctttctcctagctcatctgggacatcatcatagcctcctgcttctactacgtcgccaccacttacttccctctcctccctcaccccctctcctgggcctgccaagggtgcgtcctaaccggcgtctgggtcatagcccacgagtgcggccaccacgccttcagcgactac

SEQ ID NO: 6211 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgtgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcagcgactac

SEQ ID NO: 6212 - DNA, 300 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtctctctactgggcctgccaagggtgcgtcctaaccggcgtctgggtcatagcccatgagtgcggccaccacgccttcagcgactac

SEQ ID NO: 6213 - DNA, 335 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctcctctctactgggcctgccagggctgcgtcctaaccggcgtctgggtcatagcccacgagtgcggccaccacgccttcagcgactac

SEQ ID NO: 6214 - DNA, 335 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctcctctctactgggcctgccagggctgcgtcctgaccggcgtctgggtcatagcccacgagtgcggccaccacgccttcagcgactac

SEQ ID NO: 6215 - DNA, 417 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccacgtcgtcaggacacgatcgcagcgctgccagggcgagatcctccgcgctgtagaagtccccattgttgtgcgggcctctctactgggcctgccaagggtgcgtcctaaccggcgtctgggtcatagcccacgagtgcggccaccacgccttcagcgactac

SEQ ID NO: 6216 - DNA, 351 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcacgtaccctgcgagacaccgccattcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctggcctctctactgggcctgccagggctgcgtcctaaccggcgtctgggtcatagcccacgagtgcggccaccacgccttcagcgactac

SEQ ID NO: 6217 - DNA, 387 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcccccggagcaggtggtggccatcgccagccacgatggcgcctggcctctctactgggcctgccagggctgcgtcctaaccggcgtctgggtcatagcccacgagtgcggccaccacgccttcagcgactac

SEQ ID NO: 6218 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccttggcctctctactgggccggccagggctgcggcctaaccggcgtctgggtcatagcccacgagggcggccaccacgccttcagcgactac

SEQ ID NO: 6219 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgtcaagggtgcgtcctaaccggcgtctgggtcatagcccacgagtgcggccaccacgccttcagcgactac

SEQ ID NO: 6220 - DNA, 351 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgcgtggcctctctactgggcctgccagggctgcgtcctaaccggcgtctgggtcatagcccacgagtgcggccaccacgccttcagcgactac

SEQ ID NO: 6221 - DNA, 355 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcgcctggcctctctactgggcctgccagggctgcgtcctaaccggcgtctgggtcatagccaacgagtgcggcaaccacgccttcagcgactac

SEQ ID NO: 6222 - DNA, 390 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttgctggcggtggcaagcacctgctggtgggtcaagccttggccggcctctctactgggcctgccaagggtgcgtcctaacgggcctctgggtcatcgcccacgaatgcggccaccacgccttcagcgactac

SEQ ID NO: 6223 - DNA, 357 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctactccccccgcctggcctctctactgggcctgccagggctgcgtcctaacgggcctctgggtcatcgcccacgaatgcggccaccacgccttcagcgactac

SEQ ID NO: 6224 - DNA, 334 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctcgatccctcgctctttctcctacctcatctgggacatcatcatagcctcctgcttctactacgtcgccaccacttacttccctctcctccctcacccactctctactgggcctgccagggctgcgtcctaaccggcgtctgggtcatagcccacgagtgcggccaccacgccttcagcgactac

SEQ ID NO: 6225 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaccatcaagcgcgtaccctgcgagacaccgcccttcactgtcggagaactcaagaaagcaatcccaccgcactgtttcaaacgctcgatccctcgctctttctcctacctcatcttggacatcatcatagcctcctgcttctactacgtcgccaccacttacttccctctcctccctcaccctctctcctatcctctctactgggcctgccagggctgcgtcctaaccggcgtcttggtcatagcccacgagtgcggccaccacgccttcagcgactac

SEQ ID NO: 6226 - DNA, 335 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctcacctactgggcctgccagggctgcgtcctaaccggcgtctgggtcatagcccacgagtgcggccaccacgccttcagcgactac

SEQ ID NO: 6227 - DNA, 341 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctggcctctctactgggcctgccaaggctgcgtcctaacgggcctctgggtcatagcccacgagtgcggccaccacgccttcagcgactac

SEQ ID NO: 6228 - DNA, 350 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctggcctctctactgggcctgccagggctgcgtcctaacgggcctctgggtcatagcccacgagtgcggccaccacgccttcagcgactac

SEQ ID NO: 6229 - DNA, 349 bp, Artificial
  Mutation in BnaA.FAD2.a introduced by TALE nuclease pair BnFAD2_T01
caggatccatgggtgcaggtggaagaatgcaagtctctcctccctccaaaaagtctgaaaccgacaacatcaagcgcgtaccctgcgagacaccgcccttcactgtcggagaactcaagaaagcaatcccacctcactgtttcaaacgctccatccctcgctctttctcctacctcatctgggacatcatcatagcctcctgcttctactacgtcgccaccacttacttccctctcctccctcaccctctctcctcctccggcctctctactgggcctgccaagggtgcgtcctaacgggcctctgggtcatagcccacgagtgcggccaccacgccttcagcgactac

SEQ ID NO: 6230 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctccctggcctctctactgggcctgccaagggtgcgtcctaaccggcgtctgggtcatagcccacgagtgcggccaccacgccttcagcgactac

SEQ ID NO: 6231 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcccccctcaccccctctcctactcctggcctctctactgggcctgccagggctgcgtcctaaccggcgtctgggtcatagcccacgagtgcggccaccacgccttcagcgactac

SEQ ID NO: 6232 - DNA, 339 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcgtccctcaccctctctcctacttactgggcctgccagggctgcgtcctaaccggcgtctgggtcatagcccacgagtgcggccaccacgccttcagcgactac

SEQ ID NO: 6233 - DNA, 348 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcacttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttggcctctctactgggcctgccagggctgcgtcctaaccggcgtctgggtcatagcccacgagtgcggccaccacgccttcaacgactac

SEQ ID NO: 6234 - DNA, 343 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaaggctgcgtcctaacgggcctctgggtcatagcccacgagtgcggccaccacgccttcagcgactac

SEQ ID NO: 6235 - DNA, 387 bp, Artificial
  Mutation in BnaA.FAD2.a introduced by TALE nuclease pair BnFAD2_T01
caggatccatgggtgcaggtggaagaatgtaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctccttctcctacctcatctgggacatcatcatagcctcctgcttctactacgtcgccaccacttacttccctctcctccctcaccctctctcctacttcgccgccatcgtggctggcgatggccaccacctgctcctggcctctctactgggcctgccagggctgcgtcctaaccggcctctgggtcatagcccacgagtgcggccaccacgccttcagcgactac

SEQ ID NO: 6236 - DNA, 358 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaatcccaccgcactgtttcaaacgctcgatccctcgctctttctcctacctcatctgggccatcatcatagcctcctgcttctactacgtcgccaccacttacttccctctcctcccgcaccctctctcctacttcgccgggtctggcctctctactaggcctgccagggctgcgtcctaaccggcgtctgggtcatagcccacgagtgcggccaccacgccttcagcgactac

SEQ ID NO: 6237 - DNA, 346 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccaaggctgcgtcctaacgggcctctgggtcatcgcccacgaatgcggccaccacgccttcagcgactac

SEQ ID NO: 6238 - DNA, 354 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgcccctggcctctctactgggcctgccagggctgcgtcctaaccggcgtctgggtcatagcccacgagtgcggccaccacgccttcgcgactac

SEQ ID NO: 6239 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttctgacccctctactgggcctgccagggctgcgtcctaacgggcctctgggtcatagcccacgagtgcggccaccacgccttcagcgactac

SEQ ID NO: 6240 - DNA, 346 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttccctctctactgggcctgccagggctgcgtcctaaccggcgtctgggtcatagcccacgagtgcggccaccacgcctcagcgactac

SEQ ID NO: 6241 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgcccgatccctcgctctttctcctacctcatctgggacatcatcatagcctcctgcttctactacgtcgccaccacttacttccctctcctccctcaccctctctcctggcctctctactgggcctgccagggctgcgtcctaaccggcgtctgggtcatagcccacgagtgcggccaccacgccttcagcgactac

SEQ ID NO: 6242 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctggcctctctactgggcctgccagggctgcgtcctaaccggcgtctgggtcatagcccacgagtgcggccaccacgccttcagcgactac

SEQ ID NO: 6243 - DNA, 338 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctctctctactgggcctgccaagggtgtgtcctaaccggcgtctgggtcatagcccacgagtgcggccaccacgccttcagcgactac

SEQ ID NO: 6244 - DNA, 346 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccaccgcactgtttcaaacgctcgatccctcgctctttctcctacctcatctgggacatcatcatagcctcctgcttctactacgtcgccaccacttacttccctctcatccctcaccctctctcctacttcctctctactgggcctgccagggctgcgtcctaaccggcgtctgggtcatagcccacgagtgcggccaccacgccttcagcgactac

SEQ ID NO: 6245 - DNA, 348 bp, Artificial
  Mutation in BnaA.FAD2.a introduced by TALE nuclease pair BnFAD2_T01
caggatccatgggtgcaggtggaagaatgaagggtatactcccttccaaaagtctgaaacccaccacatcaagcgcgtaccctgcgaggcaccccccttcactgttggagaactcaagaaagcaatcccacctcactgtttcaaacgcttgatccctcgctctttctcctacctcattcgggacatcatcatagcctcctgcttctactacctccccaccacttacctccctctcctccctcaccctctctcctacttcggcctctctactgggcctgccaagggtgcgtccgaaccggcggctgggtcatagcccacgattgcggccaccacgccttcagcgactac

SEQ ID NO: 6246 - DNA, 426 bp, Artificial
  Mutation in BnaA.FAD2.a introduced by TALE nuclease pair BnFAD2_T01
caggatccatgggtgcaggtggaagaatgcaagtctctcctccctccagctcccccggaaccaacaccctcaaacgcgtcccctgcgagacaccaccattcactctcggagacctcaagaaagcaattccaccgcactgtttcaaacgctcgatccctcgctctttctcctacctcatctgggacatcatcatagcctcctgcttctactacgtcgccaccacttacttccctctcctccctcaccctctctcctacttatggacgccacctccctctgatagttgagtcgatacttcggcgatcaccgcttccctcataatgtttaactttgttttggcctctctactgggcctgccagggctgcgtcctaaccggcgtctgggccatagcccacgagtgcggccaccacgccttcagcgactac

SEQ ID NO: 6247 - DNA, 347 bp, Artificial
  Mutation in BnaA.FAD2.a introduced by TALE nuclease pair BnFAD2_T01
caggatccatgggtgcaggtggaagaatgcaagtctctcctccctcaagctcccccggaaccaacaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctcctcgcctctctactgggcctgccagggctgcgtcctaaccggcgtctgggtcatagcccacgagtgcggccaccacgccttcagcgactac

SEQ ID NO: 6248 - DNA, 343 bp, Artificial
  Mutation in BnaA.FAD2.a introduced by TALE nuclease pair BnFAD2_T01
caggatccatgggtgcaggtgcaagaatgcaagtgtctcctcactccaaaaagtctgaaaccgacaacatcaagtgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacctctctactgggcctgccaagggtgcgtcctaaccggcgtctgggtcatatcccacgagtgcgtccaccacgccttcagcgactac

SEQ ID NO: 6249 - DNA, 329 bp, Artificial
  Mutation in BnaA.FAD2.a introduced by TALE nuclease pair BnFAD2_T01
caggatccatgggtgcaggtggaagaatgcaagtgcctactccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactgccaagggtgcgtcctaaccggcgtctgggtcatagcccacgagtgcggccaccacgccttcagcgactac

SEQ ID NO: 6250 - DNA, 354 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatcgcctcctgcttctactacgtcgccaccacttacttccctctcctccctcaccctctctcctacttcgccttggcctctctactgggcctgccagggctgcgtcctaaccggcgtctgggtcatagcccacgagtgcggccaccacgccttcagcgactac

SEQ ID NO: 6251 - DNA, 350 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatggcctcctgcttctactacgtcgccaccacttacttccctctcctccctcaccctctctcctacttatggcctctctactgggcctgccagggctgcgtcctaaccggcgtctgggtcatagcccacgagtgcggccaccacgccttcagcgactac

SEQ ID NO: 6252 - DNA, 325 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcccctgcttgggtgcgtcctaaccggcgtctgggtcatagcccacgagtgcggccaccacgccttcagcgactac

SEQ ID NO: 6253 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcttggcctctctactgggcctgccagggctgcgtcctaaccggcgtctgggtcatagcccacgagtgcggccaccacgccttcagcgactac

SEQ ID NO: 6254 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactcctctctactgggcctgccaaggctgcgtcctaacgggcctctgggtcatagcccacgagtgcggccaccacgccttcagcgactac

SEQ ID NO: 6255 - DNA, 344 bp, Artificial
  Mutation in BnaA.FAD2.a introduced by TALE nuclease pair BnFAD2_T01
caggatccatgggtgcagggggaagaatgcaagtgtcttctccctccaaaaagtgtgaaaccgacaccatcaagcgcgtaccctgcgagacaccgcccgtcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcccggcctctctactgggccggccagggctgcgtcctcaccggcgtctgggtcatagcccacgagtgctgccaccacgccatcagcgactac

SEQ ID NO: 6256 - DNA, 346 bp, Artificial
  Mutation in BnaA.FAD2.a introduced by TALE nuclease pair BnFAD2_T01
caggatccatgggtgcaggtggaagaatgcaagtgtatcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctatggcctctctactgggcctgccagggctgcgtcctaaccgtcgtctgggtcatagcccacgagtgcggccaccacgccctcagcgactac

SEQ ID NO: 6257 - DNA, 352 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgccggcctctctactgggcctgccaagggtgcgtcctaacgggcctctgggtcatagcccacgagtgcggccaccacgccttcagcgactac

SEQ ID NO: 6258 - DNA, 344 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcttggcctctctactgggcctgccaagggtgcgtcctaaccggcgtctgggtcatagcccacgagtgcggccaccacgccttcagcgactac

SEQ ID NO: 6259 - DNA, 342 bp, Artificial
  Mutation in BnaA.FAD2.a introduced by TALE nuclease pair BnFAD2_T01
cggatccatgggtgcaggtggaagaatgccagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcaggcctctctactgggcctgccaagggtgcgtcctaaccggcgtctgggtcatagcccacgagtgcggccaccacgccttcagcgactac

SEQ ID NO: 6260 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcagagcccactagtgcggccaccacgccttcagccgactac

SEQ ID NO: 6261 - DNA, 349 bp, Artificial
  Mutation in BnaA.FAD2.a introduced by TALE nuclease pair BnFAD2_T01
aaggatccatgggtgcaggtggaagaatgcaagtgtctcctccctccaaaaagtccgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactctggcctctctactgggcctgccaagggtgcgtcctaaccggcgtctgggtcatagcccacgagtgcggccaccacgccttcagcgactac

SEQ ID NO: 6262 - DNA, 344 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcatcctctcgcctggcctctctactgggcctgccagggctgcgtcctaaccggcgtctgggtcatagcccacgagtgcggccaccacgccttcagcgactac

SEQ ID NO: 6263 - DNA, 300 bp, Artificial
  Mutation in BnaA.FAD2.a introduced by TALE nuclease pair BnFAD2_T01
caggatccatgggtgcaggtggaagaatgcaagtgtctcctccctcccaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtctctctactgggcctgccaagggtgcgtcctaaccggcttctggttcatagcccacgagtgcggccaccacgccttcagcgactac

SEQ ID NO: 6264 - DNA, 349 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgcccgcagcgactac

SEQ ID NO: 6265 - DNA, 349 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctcccccggcctctctactgggcctgccagggctgcgtcctaaccggcctctgggtcatagcccacgagtgcggccaccacgccttcagcgactac

SEQ ID NO: 6266 - DNA, 346 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccaccattcactctcggagacctcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcctctctactgggcctgccagggctgcgtcctaaccggcgtctgggtcatagcccacgagtgcggccaccacgccttcagcgactac

SEQ ID NO: 6267 - DNA, 387 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctgccccggagcaggtgggggccatcgccagccacgatggcgcctggcctctctactgggcctgccagggctgcgtcctaacgggcgtctgggtcatagcccacgagtgcggccaccacgccttcagcgactac

SEQ ID NO: 6268 - DNA, 345 bp, Artificial
  Mutation in BnaA.FAD2.a introduced by TALE nuclease pair BnFAD2_T01
caggatccatgggtgcaggtggaagaatgcaagtgtctcatccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctcgccctggcctctctactgggcctgccagggctgcgtcctaaccggcgtctgggtcatagcccacgagtgcggccacaacgccttcagcgactac

SEQ ID NO: 6269 - DNA, 350 bp, Artificial
  Mutation in BnaA.FAD2.a introduced by TALE nuclease pair BnFAD2_T01
caggatccatgggtgcaggtggaagaatgcaagtgtctcctccctccaataagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttatggcctctctactgggcctgccagggctgcgtcctaaccggcgtctgggtcatagcccacgagtgcggccaccacgccttcagcgactac

SEQ ID NO: 6270 - DNA, 347 bp, Artificial
  Mutation in BnaA.FAD2.a introduced by TALE nuclease pair BnFAD2_T01
caggatccatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccatctcctccctcaccctctctcctacttgcctctctactgggcctgccagggctgcgtcctaaccggcgtctgggtcatagcccacgagtgcggccaccacgccttcagcgactac

SEQ ID NO: 6271 - DNA, 351 bp, Artificial
  Mutation in BnaA.FAD2.a introduced by TALE nuclease pair BnFAD2_T01
caggatccatgggtgcaggtggaagaatgcaagtgtctcctccatccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctacttcgaggcctctctactgggcctgccaagggggcgtcctaaccggcggctgggtcatcgcccacgaatgcggccacgacgccttcagcgactac

SEQ ID NO: 6272 - DNA, 332 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcagcctctctactgggcctgccaagggtgcgtcctaacgggcctctgggtcatagcccacgagtgcggccaccacgccttcagcgactac

SEQ ID NO: 6273 - DNA, 323 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctcgagccacccactgggcctgccaagggtgcgtcctaacgggcctctgggtcatagcccacgagtgcggccaccacgccttcagcgactac

SEQ ID NO: 6274 - DNA, 410 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccacctcactgcttcaaacgctccatccctcgctccttctcctacctcctcttcgacatcctcgtctcctcctccctctaccacctctccacagcctacttccctctcctccctcaccctctctcctactttgcccgccaccctccgggccgttgcttcacaacgttcaaatccgctcccggcggatttgtctggcctctctactgggcctgccagggctgcgtcctaaccggcgtctgggtcatagcccacgaatgcggccaccacgccttcagcgactac

SEQ ID NO: 6275 - DNA, 349 bp, Artificial
  Mutation in BnaA.FAD2.a introduced by TALE nuclease pair BnFAD2_T01
caggatccatgggtgcaggtggaagaatgcaagtctctcctccctccagctcccccgaaaccaaaaccctcaaacgcgtcccctgcgagacaccacccttcactctcggagacctcaagaaagcaatcccacctcactgcttcaaacgctccatccctcgctctttctcctacctcatctgggacatcatcatagcctcctgcttctactacgtcgccaccacttacttccctctcctccctcaccctctctcctactttggcctctctactgggcctgccagggctgcgtcctaaccggcgtctgggtcatagcccacgagtgcggccaccacgccttcagcgactac

SEQ ID NO: 6276 - DNA, 333 bp, Artificial
  Mutation in BnaA.FAD2.a introduced by TALE nuclease pair BnFAD2_T01
caggatcatgggtgcaggtggaagaatgcaagtgtctcctccctccaagaagtctgaaaccgacaccatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcacccactctctactgggcctgccagggctgcgtcctaaccggcgtctgggtcatagcccacgagtgcggccaccacgccttcagcgactac

SEQ ID NO: 6277 - DNA, 345 bp, Artificial
  Mutation in BnaA.FAD2.a introduced by TALE nuclease pair BnFAD2_T01
caggatccatgggtgcaggtggaagaatgcaagtgtctcctccctccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccagggctgcgtcctaaccggcgtctgggtcatatcccacgagtgcggccaccacgccttcagcgactac

SEQ ID NO: 6278 - DNA, 345 bp, Artificial
  Mutation in BnaA.FAD2.a introduced by TALE nuclease pair BnFAD2_T01
caggatccatgggtgcaggtggaagaatgcaagtgtctcctccttccaaaaagtctgaaaccgacaacatcaagcgcgtaccctgcgagacaccgcccttcactgtcggagaactcaagaaagcaatcccaccgcactgtttcaaacgctcgatccctcgctctttctcctacctcatctgggacatcatcatagcctcctgcttctactacgtcgccaccacttacttccctctcctccctcaccctctctcctaggcctctctactgggcctgccagggctgcgtcctaaccggcgtctgggtcatagcccacgagtgcggccaccacgccttcagcgactac

(The sequence listing continues in the following parts.)

What is claimed is:

1. A method for producing a *Brassica* plant having increased oleic acid content and decreased linolenic acid content, the method comprising:
   providing a population of *Brassica* cells comprising Fatty Acid Desaturase 2 (FAD2) gene copies,
   contacting the population of *Brassica* cells with one or more rare-cutting endonucleases targeted to the one or more FAD2 gene copies, wherein the one or more rare-cutting endonucleases are transcription activator-like effector (TALE) nucleases, wherein each of the one or more TALE nucleases is targeted to a sequence within SEQ ID NO:1, or to a sequence having at least 90% identity to a sequence within SEQ ID NO:1; and within the sequence set forth in SEQ ID NO:10, or to a sequence having at least 90% identity to SEQ ID NO:10,
   regenerating *Brassica* plants from the population of *Brassica* cells contacted with the one or more rare-cutting endonucleases, and
   selecting a *Brassica* plant with a knockout mutation in two or more FAD2 gene copies,
   wherein the selected *Brassica* plant produces oil having increased oleic acid content and decreased linolenic acid content as compared to oil produced by a corresponding wild type *Brassica* plant, wherein the oleic acid content of the oil is increased by 25% as compared to oil produced by the corresponding wild-type *Brassica* plant.

2. The method of claim 1, wherein the *Brassica* cells are selected from the group consisting of protoplast cells, embryo cells, callus cells, leaf cells, and petiole explant cells.

3. The method of claim 1, wherein the knockout mutation in the two or more FAD2 gene copies comprises an in-frame or frameshift mutation.

4. The method of claim 1, wherein the linolenic acid content is decreased by at least 30%, as compared to oil produced by a corresponding wild type *Brassica* plant.

5. The method of claim 1, wherein the oil has decreased linoleic acid content as compared to oil produced by the corresponding wild type *Brassica* plant.

6. The method of claim 5, wherein the linoleic acid content is decreased by at least 80%, as compared to oil produced by a corresponding wild type *Brassica* plant.

7. The method of claim 6, wherein the linolenic acid content is decreased by at least 30%, as compared to oil produced by a corresponding wild type *Brassica* plant.

8. The method of claim 3, wherein the in-frame or frameshift knockout mutation in the two or more FAD2 gene copies comprises an insertion or deletion selected from the group consisting of:

a 3 bp deletion at positions 98-100 of SEQ ID NO:1 or at the corresponding positions within a sequence having at least 90% identity to SEQ ID NO:1;

a 6 bp deletion at positions 97-102 of SEQ ID NO:1 or at the corresponding positions within a sequence having at least 90% identity to SEQ ID NO:1;

a 3 bp deletion at positions 99-101 and a 1 bp insertion at position 99 of SEQ ID NO:1 or at the corresponding positions within a sequence having at least 90% identity to SEQ ID NO:1;

a 7 bp deletion at positions 98-104 of SEQ ID NO:1 or at the corresponding positions within a sequence having at least 90% identity to SEQ ID NO:1;

a 13 bp deletion at positions 92-104 of SEQ ID NO:1 or at the corresponding positions within a sequence having at least 90% identity to SEQ ID NO:1;

a 6 bp deletion at positions 96-101 and a 50 bp insertion at position 96 of SEQ ID NO:1 or at the corresponding positions within a sequence having at least 90% identity to SEQ ID NO:1; and an 18 bp deletion at positions 101-118 and a 166 bp insertion at position 101 of SEQ ID NO:1 or at the corresponding positions within a sequence having at least 90% identity to SEQ ID NO:1.

* * * * *